United States Patent 10,407,724 (METHODS AND COMPOSITIONS FOR SCREENING AND TREATING DEVELOPMENTAL DISORDERS) - sequence listing, part 29

SEQ ID NO: 626 - DNA, 1503242 bp, Homo sapiens
cctcatcatgaggctagatttcaacctcacttcctttcaccaaggaaacttaagatcctgtggtttcctgttagatttctgtaggaggctctcaggtactgctgccacttttgctggtggtgacagaagcaacctcagacttgtgcgtttggccattttgagctgtactttcaaacaatccagagaccaattttcctagaatcaaggagatagaggccataatccgttgaacaagtgttctcttgaaagcaggtacaacgttaccactatcttgtataaggtgcaccaatgccagagggcaacctaacattctggaattatttttttcccttgaaatttctctccagcagtaactgcactatagtttatcccctgttgttgatttattgttatttctctgaattatcttagctaattcagagaaacttttttcccctccaaactttgtcattcaattctggcggtgggggagttcacagggattcatgtaaagcttctcaatcttattagtgtcagataaatgcaaatgaagtaacattgagatgctacaccttgtacacataagattggcaaacgtttaaaagttggtgttttagttatgtattgctgcataacaaactatccctcaaattaatgacaatgcccttaagattcatgaaatctcttttacatagcaaggagggtctaggaggcacattctgaaatctttctgacatctcaaaaaatggtttaacagctgcatcttcatttgaggatttacctcgatatttatccttagatcaaattttgctgacaacatgctggatttgatctttgaattttctgcctttgagaactttctgattgctagtatagaaagaccaccatggggcctcaatgtttcttgaaattctgctaaaaaatggaacaattcctttctatcttgtattttaccataggaagccagagaaagcaatctgtcatgtttaacattctgcctggaaatttccctagctagatcttatcagatcaaatgaactgtagagttaatttctgggaagaaaccacctcaactgcctcgcgccttctgcgtgttagaagggaatcgagtctggtgccaggattcaacgagaagggagcggtacatcccaaaccatgaatttcataacgctggtctccggggaaaatactgacattctactccattactcttgagccttgagcaactgaagaggttgagtttgtgaatacatgctgtcagacaggattaccttgggaaacagtgaaacatgcaaaacctctgaggagtccaatatttgttaaatgaatttacagaagagactcactggaaacatttaacatttatatgaggttgggtaaatagaatgatattttcattcaattcactattatctgttaaacacatactttttttttttttttttcgatggaatcttgctctggctaattttcgtatttttagtagagacagggtttcaccatgttggccagtctgatctcaaactcctgatctcaagtgatctgcctgccttggcctcccaaagtgttgggattacaggcgccacgcccagccaacacctcttttttacgaagtactgcatgagtaacttggggttgcaaccaaagggtgtccttgctttcaaataggatatttcatagaatatgacttaaataaatacatgatgacatagagttatattccaagtgagctcccactaaattattgcttttcaaattctttttggttaccattggttcacatgtactatctttcttaatataggatcactaatattgaggagatcctatttataaaaacaatcacttgtgtctaagattgattgttaatgtcaatataatgcatatcatctgtaaaaaggaaatttgtaagaaggaaatattaaaaaatacctgccagaacaacaggattctgaaagattctgtttggaaaaaacaaacaaacgaacaaaaaaacgttttatggggctaggttttatacctctttcccagttattttcttttgctttcttcaccacgttgtggcaggccaggtttcactaactcaggcttccataacaacggtttcagcactgaccgagtggttccatcaaatattaacagctgagagagtcagtgcccttctgcaaaggctggaatgtcacaaaagcccatcaagagctttgcctcggcctttcctgggccttaaatcatgacaggataatgaaggaattcttaacgggacccgtttaggagtaaataagttttattggggggtccaaagaaactccccaggcctccacaaacaagccttattgggtactaaagaaactccccaaacctccatgatttagcaggagacaagacaaaggtattgaccccagcacctggacccatttaggttaagtaaatttactcaggttccagaggaagagcttcaagactcagaccttagttatagatgaaaagaagttaatcacttatgtctttagatgaatgcacaaatgcacacttacatgtagacatatagcttagaaggtatacaagctctggaaaactttgtagttttgagttggtctggggataatttcaaggccttctccctgtaactggttacagaaataaaaacttgattctctcccagttcatctgcatctcgttattgggctgcgagaataagtagcccgacccttggcttggtcaggaacagcatgacataagagacagagcactggctttgtaatcagttgatctgggttcaaatcctgattctatcacttaaaagctgtgtgacattgggtgtaccaaatgtctctgtgcctctgtttcttcatgggtaaaatcatggtaatactttacatcccccccccataattcggtgcctggcccagtgtcaagactcagtatttattattgagttgttattatcgttacggtgaatgacgtcgcaaatgttcctggcatttacagacaggtctccactgcacggttgtcacaatggttactcttttggggagctcccatcggagcagctgcttccaccttgctttattttcctgcagataatgtcctgttcccgtcattatctgctaacttcttgactgaatgcctgataggagctcagatagccaagtgtggctttgtgccacaccctcctaacatagctcgttttctgttcctatggactacagaatgcgctctagggtttgaactgcagacctgttcctgcgtcattctctatgtttgacttgtggccatcctagtgaggttaaatgaagctctgaggtgaaagcaggaaggattcggttcagggagagcgtttgtttgatacaggtgttatacatgatgaactatccatcagggacagggatcagagcagaggtcagagaagagtggtggaggtgagaacctgccatgatcgggagaggagggagggatgtcacagtaacatgcagtctgctaatatttggcagattgtcatcttcatgacctcaatggtcttgttagttcctgccgcaattttgcagttatgtagggtcacccctgctctccccatccagacaatgctgatgaaagagatattagcaagagataccatccagatcaaatatatcttacagagatcagtgcaactttgcatgaatgagtccaactttgcacgaagtaagagtccaggactcttacttcctgagtatcctgaaacccagtgcatcttttccctggggaaaatgaaaacacaaagccatccaaaaaaaacaagcaaaatatattggaaggaaactctggtatataacattgagctgctggtttgaaaagcagtgacctctctgtgcaaatgatttttttttccaaacagagctgaacaaggtaagattctgggttaatggcttccataacgattaaaattaaaatgtaaaccatctgtagtagggcttacagccctgcaggaacttacagaaccatcaaataattttaataaactgcttatgcaagcctatttctatgggaggtcagactccagtctctctttaagaggctgccaagacaccctggactcagatgataaggcatctgcgtgttctctgaggccaagactgcgaaaatgtgtctcagcaggcaaggggggaaaactgatacctttataaaagacatattaaaaagtgagaggtctctagggattttcttgaaactaccattaaagctacatcatctctctttccccagaaagcccacttggattaagctcatcaaccaatgggaatgtcagtgattggatggttgtatgtcggcgtgaaacaatggttatctgttaaactgaattttatatccgtgtggtgttcagttttttccctcaggatctgggatagtgaaagttcccttgatctgtgggctttgtctttgtggtgctaactgctgaagtacttgcctccagaataggcacctctgctgacggctagagccacaaacattcctgatcccactggtggcgttttcctattaagttgggtgcacatttccatacagacacgatcaaacattgcatgttatgattagaaataaagctgaggactgagaaactgaatatacaatgaccagaccatatataaaaacagaatgttgacccgtcacctgcagcaacctgcccaagaaaccaacccctatttacagtaagcaacccaggaatccagcctgctatataaaccacacttgcaggaagccagattgctatcttggaaggtaaataatttctgtaacgatcggccccagatggccaggacttaataactgaagcttccctaattttgcccttgctttcaacttaggaccaactaaagaaagtcaaacatgtacctcttacctatcacacagggtgccctgcacgtagttagcttacctccagcttcttcacgccaacagtccaatcagcacacctgagccttctcttccgtgggtcttaaagcttttgcattcctctgcctgcctttgagtctctgcgcaaacgctagtgatggtggccgactcctttgctatagcaagctcagaatcgatagcctttgcttttctcctttggtctttgttcagtactatagtttaaatagactttgtgagccagttggtttctaaatcattctaactgccattcactcacttactgaagaaatatttactaaaagcttcaatataggccatatttcttgctagacacaggagcaaatgaaataagataggggccctcccctagaggacagtaacttggcaactaaagggatgaacgggatgacttggcaaccaagtcaaagggcattaaaatacagaggcggactcaaacgaagatggccgaataggaacagctccggtctacagctcccagcgtgagcaaagcagaagacgggtgatttctgcatttccatctgaggtaccaggttcatgtcactagggagtgccaggcagtgggcgcaggtcaatgggtgcgcgcacggtgcgcgagccgaagcagggcgaggcattgcctcacttgggaagcgcaaggggtcagggagttccctttctgagtcaaagaaaggggtgacggacgcacctggaaaatcgggtcactcccacccgaatattaaccttttcggaccggcttaaaaaacggcgcaccacgagattatatcacacacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagcccggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagacgatcaaattactctgagctacgggaggacattcaaaccaaaggcaaagaggttgaaaactttgaaaaaaatttagaagaatgtataactagaataaccaatacagagaagtgcttaaaggagctgatggagctgaaaaccaaggctcgagaactacgtgacgaatgcagaagcctcaggagctgatgcgatcaactggaagaaagggtatcagtgatggaagatgaaatgaatgaaatgaagcgagaagggaagtttagagaaaaaagaataaaaagaaatgagcaaagcctccaagaaatatgggactatgtgaaaagaccaaatctacatctgattggtgtacctgaaagtgatggggagaatggaaccaagttggaaaacactctgcaggatattatccaggagaacttccccaatctagcaaggcaggccaacgttcagtttcaggaaatacagagaacgccacaaagatactcctcgagaagagcaactccaagacacataattgtcagattcaccaaagttgaaatgaaggaaaaaaatgttaagggcagccagagagaaaggtcggattaccctcaaagggaatcccatcaaactaacagcggatctctcgggagaaaccctacaagccagaagagagtgggggccaatattcagcattcttaaagaaaagaattttcaacccagaatttcatatccagccaaactaagcttcataaatgagggagaaataaaatactttacagacaagcaaatgctgagagattttgtcaccaccaggcctgccctacaagagctcctgaaggaagcgctaaacatggaaaggaacaaccgctgcaaaatcaagccaaaatgtaaagaccatcgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcaagtgcagagacacacataggctcaaaataaaaggatggaggaagatctaccaagcaaatggaaaacaaaaaaaggcaggggttgccatcctagtctctgataaaacagactttaaaccaacaaagatcaaaagagacaaagaaggccattacataatggtaaagggatcaattcaacaagaagagctaattatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagagattataacaaactatctctcagaccacagtgcaatcaaactagaactcaggattaagaatctcactcaaaaccgctcaactacatggaaactgaacatcctgcttctgaatgactactggatacctaacaaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaggagctggttttttgaaaggatcaacaaaattgatagaccactagcaagactaataaagaaaaaaagatagaagaatcaaatagacacaataaaaaatgataaaggggatatcaccaccgatcccacagaaatacaaactaccatcagagaatgctacaaacacctctacgcaaataaactagaaaatctagaagaaatggataaattcctcgacacatacactctcccaagactaaaccaggaagaagttgaatctctgaatagaccaataacaggatctgaaattgtggcaataatcaatagcttaccaaccaaaaagagtccaggaccagacggattcacagccgaattctaccagaggtacaaggaggaactggtaccattccttctgaaactattccaatcaatagaaaaagagggaatcctccctaactcattttatgaggccagcatcatcctgataccaaagccgggcagagacacaaccaaaaaagagaattttagaccaatatccttgatgaacattgatgcaaaaatcctcaataaaatactggcaaaacgaatccagcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaattctcagtaaattaagtattgatgggacgtatttcaaaataatgagagctatgacaaacccacagccaatatcatactgaatgggcaaaaactggaagcattccctttgaaaacgggcacaagacagggatgccctctctcagcactcctattcaacatagtgttggaggttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctcataagcaacttcagcaaagtctcaagatacaaaatcaatgtagaaaaatcacaagcattcttatacaccaacaacagacaaacagagagccaaatcgtgagtgaactcccattcacaattgcttcaaagacaataaaatacctaggaatccaacttacaagggatgcgaaggacctcttcaaggaaaactacaaaccactgctcaaggaaataaaagaggatacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttcaagttcatatggaaccaaaaaagagcctgcatcaccaaggcaatcctaagccaaaagaacaaagctggaggcatcacgctacctgacttcaaactatactacaaggctacagtaaccaaaacagcatggtactggtaccaaaacagagatataggtcaatggaacagaacagagccctcgaaaataacgccgcatatctacaactatctgatcttggagaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttctgcacagcaaaagaaactaccatcagagtgaataggcaacctacagaatgggagaaaattttcacaacctactcatctgacaaagggctaatatccagaatctacaatgaactcaaacaaatttacaagaaaaaaacaaacaaccccatcaaaaagtgggtgaaggacatgaacagacacttctcaaaagaagacatttatgcagccaaaaaacacatgaaaaaatgctcgtcatcagtggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgttgctataaagacacatgcacacgtatgtttattgcggcattattcacaatagcaaagacttggaaccaacccaaatgtccaacaatgatagattggattaagaaaatgtggcacatatacaccatggaatactatgcagccataaaaaatgatgagttcatgtcctttgtagggacatggatgaaattggaaatcatcattctcagtaaactattgcaagaacaaaaaaccaaacaccacatattctcactcataggtgggaattgaacaatgagatcacatggacacaggaaggggaacatcacactctggggactgtggtggggtggggggaggggggagggatagcattgggagatatacctaatgctagatgacgatttagtgggtgcagcgcactagcatggcatatgtatacatatgtaactaacctgcacaatgtgcacatgtaccctaaaacttaaagtataataaaaaaataaaaaaattaaaaaaaataaagttgactcaaacttaaaaaaaaaaaaaatacagaggcagtgttttttaaaaagtgcatactaattcctggattcatgagataacttccaggaagttgtagatagataaacatttcaactttaatcattatacgcttgaatgcagattagaaaaattagcattttaagcttagcaaacccatgatttcagatattattgctttaggatgtcggtaacagttaaaatctagtcaggagattaaaagccacccttattttaacagaggaaattaaatattaagaattgttaattgggtattaaagaactaaacgaggcaaaaggaaaacactgaggtatcatgcaggaagctgcgactcctagggaagagagggaaattgttcaatttttgaaacttgggaggggccccaaagagccaaaactcagacctctgacattaagttgttattctgctaatatcagtgtctctgggttgggtgggggaaccctgtggccaaggcgctggacagatgtcggaatgaatacagggtggttggtgctggtgatgtctctgaggagttgctatgaggctgttgcagcaagtgttgggaagactaaactcatattaacaactcttcctggaataccagcctctgctggggtgcaggtgttttgagggtgacaaagaaataggaaaagaagaggaagcagagagaagggacacatcctgtcttcttcctctagcctcgccatctccagctgggcctccactggctgatcctaattaagtcagctgcataggagacatggggtttgctcagtcccagcccggcactaaaagctgaatacagagggtgagtttgattctgtgaagcaacagctttgaatctgccacaacctgccctttcggccatttagcatccacagacttctaacctaaacttcctgcaacaaggaaaacaactgtttctaccgaatacactgcaaacatcctttgtacaagataccctcagcctttctccaaaatgaggagacacaaagtcccagcagacattctatcagttaattacacctaaaattaatcacaaacccacctaatattcttaccctacgactaaatagcgaaattaacgccctaagaaaacaaaataaggaggtaagagaagaaattagtacacacacatacacacacacacacacacacacacacacgcagaagaaaacagtcatccctgggtatccaaggactggttccaggacctcctgcagataccaaaatccacagatgctcaaaccccttaccttagacagcatgtttgcatataacttacgtgcatcctcctgtatcccttagactacctctagatgatttatgatgcctaatacaatgtcaatgctatgtagttgtcatactgtattgtactttatattattttttattgtatttttattttttgagtactttctgtggttagtcaagtcgatatctggaactcactgatatggagtgccaaccctccatgtaacagttgcagtaacttgtttctgtaactggctagtcataaggctgaaataataaatttccttctttccttacacatcccatggttcctcttccctcagccagtagctcagcttctcaggatttatacggggtggggtgtaccaaaacatcattccctaaaggacctcaatcattcccctctttgagactgttatagctgtcccttagaagttagtggcatacatgggaagtgctaaaaatgccctagagaatccttgggttccagatgcctttctcaccatccactgtgtaggaacgacataaatgcccctttgttgccaggatcacttgcaccagccaaaacagtaacctccagcccgttggttcagtgctgaaatgactggatagtctcaattcctgtctcaatggagccattgttgtgtcccctagcgggagcactcctcccttgggaactcaagagaagcaggaaacaaatcacccatgagtgggaccactccatctacctctgcttgattccagaccgtgcattctgaccaagaacagtcccatggagtggtcactcaatcaaagcacacgttacatttgtcagatggagttgtattccacctagggccataaatgtgtcttcagcagaccattccatcgtcctattatgcccgctattcctgggtgatgggggatatgctaagaccagtgcactcaagaggcataagcccccattaccccacttcttttatggtgaaatgagtttgtcaatcagaagtcgactgtgcagacaggtacataagacacgtagtaagtccggtagtaagtccgtggattgtggtgctggtaaggcactgggaagaactcgttacttcccagagttgggaggtgcatcattctcatactcacagtgaaaaaaaaaaaaaaggccagattaacttcaaagtcctatcttttctcataactcaccagagaactgaggtcacagagcaataaaaccttccttacagagatttgaggagagaggagacatgtacctcattcacttcctgggagcgaaattaaatcagtagttctcagaagtcctaggtacttatctgcagacagaaagacagacacacatacacacacttaattctatgtgcttctttctgtacttagcatttagaatagagttcagactaggagatggtaccattggtcagtggtaaattctgttgggttataccgtaagaaactaaaggttatttttgacctgtaaaaggcaatttcttatggttcaacctaatacatcactatattctgatcaatggctgttttttaaagttattatttggaaaaaagttatattactgaattagactaaaattgttatttgaaagtacaagaaaatataaaaagtatgtgaaagtagatttttattacagagcaaatttttctatcaattcaatgctttaaataaaacaacataataccataaactgacaatgacctgggagcatgtaaatacttaaggctggagaggcatttttattcttgataaatttatataataaattcttatgacatttgattccaaattgtatgtacgaattggcttgacataataaatataaacataagggcaatttaaacattggcagtagtttatgtaagtcaattcaaggtcagtgactggagaactatattaagagaaacctgaggtaaaaaaaatctttaggaagcagccctgtaacaatgtacatttgtagatcaggggctaaaaatccactctgaatgaataccaagaagcaaaggatgtacaacatccatcacacatctgtttcaaaaacagcatgtttctaaaatgataatctctttacaagtaaacgttacagtattaataactatagagacaccattgggatgagctccagatgccctgctgacttccaccaagcacccctgggccatcgcttaaggcatccatcttaatcctggggctttaagaacatcttctttgctttaattggtgttatgtctccattttcatcttcttcataattggcatggtctctctttctggcaaactttttcccaattgtccccaccaaggtctcatatctgtcaagaggacaggcagcacacgtttaatttcaaataaaaaggtagggatcaagccttgtcaagaatatcagaccaaatatgcaataaaaaagattacgaaaaagaaaactatcattaaaagaaaccatctgatttaacaatttatgaacttctctaagagtgattaaattccttgccattttggtgtttgcattaccctaaataaatagagatgtacattttaaaatacacatttccagcagctctggaaatgggccctcaactggcagcctgagacaggtctgtggcccccgtaggccattaagagaaggccgatcacagtcatcgtcctactgggggactcccttgaaagctgccgtgcactgtggggtaagaggagcattcctgggagagccaatgaatgctaggtccagattagaaggctgctgcgcagcacggttaccttctagccatctcttcatctgacacatcaagctctactgtttcatcttcaacttcttctgctttgtgcttagcattcatctgaagcatcaatttctgaaaaatacaccagtgctgaccttcaggctagaaaacgcttgtgaaaggaactgatgtcaaacttacctgaaggcagagaaactgaagtcaaataatctagagaactagtcaaaattgataagggactctctgtaatacttgataccacaatggtgtaagagaagtaagctctgagtcaaaaaaatagtaaggcaaagccccactgaattatacttagggtgaatttaaagtgtatttaagatcataaatcttagtattagttactcatatttaaagcaggcatactgctgacacattccggtgagtgggggaagaaataataaactttcagattttccctgaacttcccccacccatctttaagccatatggaagaaacactagtcgtcagtaataattttaaatgcatctcttggtggtggtggtggtgagtggaggaggtgggagaagtggaaggctggccctgtttaatggagggaatctgcacctcagccttaccctcctaaactttagagtggataatgcatcccatgtaacatccatgcaccacagggtctctcctccaactctttcacataaacctttttgtgataattatcctctgacctttttttttttaaatgtgtaatctcttctttttagcaagaggagaaggaataaaagatgagaaatcagtcttaactagtttttctaaggcttaaaagagtgataatagtttaaaaccttttcctagggggagtgtattcagtgtttcagaatccagtaattagggccattttctaacacccgtccctgccccccatcaatttctgcgggcagtggcacctctcctttcccattgcagcagacatactttggaatgctcgcctatccaaaccctactctttgaataccacatcttcataatccctgcctttttcttccctcttcaccccactgcccagcccctctccttctcaatctgaagcttaattaaagaaagtcaaagcgagaccagcatatattaaaaacaaacacttctaacataacaccttaattatcacacatgcctcctcccactccgccaaaaaagaaaaggaaaactaacctagaatctttcaataaactctggcaattggcttagttaactgtggctcctagagaagtggttcttaactggggatgattttccccaccagggaacctgtgaaaatgtctggaaacatttttggttgtcacagctgggtaggagggtggggtgtgtgtgtgctactgatatttagttggtagagaacagaggacagggatgtggttcgtcattctcttaggaaagccaccaccacaaagaattatctggccccaaatgttaacactgccaagggcaagaaacactggcttcaagtaatatttaccaaactaaagatttatatctcatgtgtccatttggttcatcaagtacttgataggatggcttttaacatatgagccagagttctaatgaatatttgttaaataaaggtctgcttctctatcctggagcaggaaaattcaaatgaatagctcagttataaggcaaatattcatttttcaaacaaactgtcgaaaggattcatttaaaaatctacttacaagcttggattacaacagtccattaaaaagtcaaatgacataattctaaagtaacatttttccgttagaaaaaatacatgtataggtgccagaaaataacttttcataatagcatgatatgaataaaatcttgacgttcctgtaaaagacacaacttgaaattttaatatttatggtggctctgtcaagggctgtatactgctatatgaaattatctactcacctctaccataaaactagactgcaatgcctccaatttctttaaatagctatggcgatatttcaagacttgttattttctatataatgagtagaaatggtacctggtggagaaacacctaagcccaattattagcagaaaaaaattcaattggaaaaatttttaatttgaagcaattatatttaatacctcaacctcaggattaaatcctctgaatgacattcttccatagagaagatcttcacatagtaagaaactctgctcttctattatgaaactcctaaatgggaaaataaaaatagcatttctccatatataaagcacagcaaacaaaagccaacactttgaataaaaaaaataatcaacctatggttctcagtagaatgaagtaaaaatacagtaagatttctaacttagggttaaaaataaaatctgattaatttggtcagcaaaggcattaggagacaagagcagcaagctagaggcacagcctctcttaaacaccacatttaatttgcataaatatctacataatataaagatctaaagtattgacaataaacttgaatttgccaaagttgaagcaaagtttcttttgtgtttacatcccctcaccatatttttttccaattctttttcagaaaggaaataatatgtatgtaaaaatacacatacagtatacagtgacacactactccaaatcattttaataaagtttctggcatattttgtctttcgttctcagggatttcaaaaattccattctctaattatcaaagcagcacattttaaggaacgtaatttggaaagcagaataaagtatgagtttataaactgcctgtaagctccttaccaagaggataaaaaggactgttagtatatttgaatatttccttccagtcttttttgtacttgcatttacgttgattcttgaacacaggtctgagctgtgtggtgcacttatacacagatttttttcaaaaaatttcaatagtttttggggaacaggtggttttttggttacatggataagttctttagtggtgacttctgagattttggcccccaccaaattcttattacaaatccaggagaagtagtgggaaatcagaggcttgagcagctttaacagtgttatcagtcagagctcttagctataaacaccaaaggctgaccctggatgacttcagcagagaaggaatttactgtaagaacactgtaggctcttcatttccaagggggactggttccaggaccccttgtagatatcaaaatctgtgacacaaagagccagctgtactgggcatctcagaatcaccgggaaggctgaaggggcagaattggaagacgggcagaaataacggtcgctaggtggttgcaccagaaccaaaatcatgctagagaatgaccctaggaaaaccactgttgctgctgacggggctgagcacgacaccactgatggcattggggcaggttgcgttccctggaccaggatgtttctgtctgcagcagaatttctctgctgagtcaccaccacatgaccgtaaatccaaggtgacatatctatctccagcctggccataaaccctaaagcatggcaggaaagcaaacatgtggcttttaaggcttgtttgccggagtaggctctgattctcataaagattcccttatgcaacaaacacttattaaaccaaactgtgtgtattaaatcaaactgcggaaacagccaccagtaaaagagcctcagctgggcacagtggcggatgcctgtagtcccagttactcaggtggctgaggcaggagaactgctcgcatcccagaagtggaagttgcaatgagtcaagattgtgccactgcactccagcctgggtgacagtgtcaaacactcacctccaaaaaaaaagaaaaaaaaggagcctctgctctcctggaggttacagtctatagaaagaggggccaaataatgaatgaaacatgaaacatttatatcacacaatggatgaaaataaagcaggttattccatccctagctgtaggggagtaattggtatggaactagctttcctgcaccataattatataaaacaggacaaaatataaaatgaccattttcagataatgaacaaatccaagcatatgactgtgatgcctgagagaagaaaatcaaatgaagtagaccccatgaatgcggagctttctgcctggaggcaatttccagattgtggagcagggagtgggggactcacacaaaaccctgtcttgctgagcttaagagacaaactgtttcattggggctttagttgaaaaaaataaaggcacaaactgaagtttggggttatggtggtggctggaatatctgggtgaggataccactgaaagggagctacactatggaattcaggacctgcatactgggttcccttgaatctttggctgaccatgaagctgcacatgtgcaggatgagtctttagacttagggaaaaagtaactgctggagagatgatttctgggagaacacctgctgcattagcttcctgtggctgctgtaacaaatttaagctgacaaaattggtggcttagagcaacagaatttatgctcctacagttctgtacaaaatccagatgttagtaggcctgggatccctccagaagcttccacggttacaaggccttctgtgtgtcaaatcttcctcacctctcctccttataaggaaaagtgattacatttagggcccacccagataatccaggataatctctcatctaaagatctgtaatttactcatataccagcaaggtaaattttgccacataaggtaacactcacaggtttcagagatgaaaacctagatattatctgggagaccattttccagcctaccatacctggggaaaaaaaatttaccctgcaattgcatgttgaagaaataacagagcttgcacagagcaaggaaatgtttgagttctgcctagccagagaggagagaacaagctaaacactctgtgatatttagtagaaaggccacaccttaggagtagagacaatttagctacaaaacacaccctaacaaaatcaagctgattggcatgtaagtcaactgcctaatgaaacaaaattcaacactctattaagaaaaataacaaaatccaggtagtcagcaatgtaatacatacaaatgtacagcacacaataaaaaattcctagacatgcaaggaagcaagaaaatgtaatcccctcatagaaagaaagaaaacaactgaaaatgaaattagtagaaatggactttagaatagttactgtaaatttattcaaggatttaaacgaaaacatgcatgcaatgaagaaagaaacagaaagcctgaattaagaaatagagactgcaaaaaaacaccaatagaacttatataattaagggaaaaaacaatttaaaaaaataaattatataactgaaaaaaaaactgcagtgaaaaactggatcagtcctatatctatcaaataaatggaattcattactaaaaatcttttcacagagaaagcttcagatccagatggcttcactggtgaatttcaccaagcatttaaggaagaaataatttcaattttacacaaaccaagaactaagaagaggaggtaggaacactttccaactcattttatggccaaaaccaaagacattacaataactctacagtctaatatcttttttaaatatagatgtgaaaatcatcaataaaatgtcagcaaattgaatttaaaaattttaaatgttacatatgaagaccaagtagagtgtatgtcagaaatacaaggctgttctgatattcaaaagtcaatagttttcaacacattaacaaaataaaaatcatgatcttctcataagaaattatttgacaaaattcaacatcatttatgatgaaaaccctcagcaaactacgaaaataaaggagtatctctgaccactgatcaggggcattgacgaaaacagcacttcatgtgtaatagagagaaagtaaatgctttcccaactgtgatcagaaacaattcaaggactactcttgtcgtttctattcaatactgtattgggtccttagccatgaaataaatcaacaagaggagataaaatgtataactgtctttttttgcagatgacataattatgcatgtaaacaatcttaaggaatccacaaaaaaactacttgtcagtgagtcaatttagcattacagaatacgaagtcaacgtacaaccttcaatttctacacacccctccaccccatacatacacacaacaaataagtttgaaaaaactctatttatgatatataaaactatgacagacttagagataaacaatgcaataagcaaagaaaattttttcaataaatgttaataggtgcagtggctcatgcctgtaatcccagcactttgggaggccaaggtgggcagatcacttgaggtcaggagttcaagatcagcctggccaacacggagaaacagtgtctctactaaaaatacaaaaattagccgggtgtggtggggcagcacctgtaatctcagctactcaggaggctggggcaggagaatcgcctgaacccgggaggtggaggttgcggtgagccaagattgcgccactgcactccagcctgggtgacagagtgacactctgtctcaaaaaaaaaaaaaaagttaataggatcacaggttatctatgaaagacatgtcctttgatttctacctcatgctgtacacaaaaagttagaggcaaaccatggataaaaatgtcagcactataactacaaaatttctagaagaaaacagaaaatatcttaccatcttggcatagccaatgattcattagacgagagtcataaggaattaaccataaaagaaaaaattgataaaatagaaactcatcaaaagacaacattaacaggctagaagaaaatattcactatatatatatgtggcaaagaacttgtattcagaacataaataactcctacatgcacagatgtatgtaagttttgtctcaaaaaaaccctagaaacactgagcttgagttaatgatgtgcatgctgcaatatttcagaaagaaatatactgatgtctgcaacttactgcatcaaaaatacaataaactgatggctggatgggggatgaacaaatatgtgatataaaatatttaaaaaaacaaaacaaaaacaaaactttctcaatttttaaaatggccaaaatatttgaaaaggcacttcacaaaggtagatatggaaatggccaaaaaggaagaagttcttcaacattatgtcatcaggaaaatgcaaattaaaaaccataataagatgccactaaaatagttaaaagtaaaaagatacataactccaaatgttggactctcacacttccttagtgaaagtgtaaaatcatagaacaaactagtctgaaaatttctgttaaagtacaattccacagttacaaaagaaatgaaaacataacaaaacaaaacttgagtatgaatgtcataccagctttatccataagcgtaaaaaaacaggctgggtgtggtgcctcatacctgtaatcccagcactttgggtatccgaggccagcgatcacctgagatcaggagttcaagaccagcctggccaacatggtctctattaaaaataaaattagccgggcatggtggtgcacgcctgtaatcccagctactccggaggctgaggcaggagaaccgcttgaacctgggaagcaggctgcagtgagccgcggttgcgccagtgcactgtagcttgggcaacagagcgagactccatttcaaaaaaaataaataaataaaaataaaaaaataaaaaactggaaacaacccaatcatgagttctttaacattattagtcatcaggaaaatgctaattaaaaaccacaatgagatgccactagaataaaattaaaaagatatctaactccaaatgttgaactctcatacttccttagtgaaagtgttataacacttctctattaatgtccattaatagaagaatgaatagatataccgtggtgtatctgtaaaatgaaataccacttagcaacagaaacaaattactgatgttccaaaacaaggatgaatatccaaaacattttgctgacacagttaagcacatattgcacaattccttttttatgaagttcaagaacagacaaaattaatctacggtttaagaaatcagaacagtgcttgcatcagagcaggagtgagactgactagaaagagggatgaagatctttacgtgatgatggaaatgtttccttgataggagtatggtttacaaagatgcatgcactatcaaaacacatacagctgtagacttaagtacattccactgaatgcaaccaccacccacacacccacacgtgcacacagtttaaggggagatactgagggcagactagaggagaggcgtcttttaaaagagtggtctggataggcctcttgtcaggggtgacatctgagcaaggaccaggaggcagtgaggaagcaagatatgaggatgcccaggtgaagaacacctgaagtccccataagtgggggccctgagaagggaatctaacctgcctgagaaacataaagcccctgcagttggaatggagacaatgcagagtagtagcaggaggtcagagttacttgcatgataacattaagatgtcatcttttactgtgttgacatttgcagactgtgcaaaagcaactctgggtaaaacgaatcttagcatgagtgaaagcagcagtgataccagactaccctggtagttacattcttcactgccaggccctcacagttcaaagaaaaatgccagtttcacattagaatgttcttgatgacacagcacaaatttatttctgttaatcttagccctcaattactttaaaaaatattcggtatacgaaattgaaactctatatataagatacttcttagccgggcgcagtggctcacacctgtaatcccagcagtttgggaggccgaagcaggaggatcacgaggtcaggaaattgagatcatcctggctaatacgatgaaaccctgtctctactaaaaaaatacaaaaaaaaaaaaaaattggctgggcatagcggcgggtgcctgtagttccagctacattggaggctgaggcagcagaatggtgtgaacccgggaggtggagtttgcagtgagcggagatctcgccactgcactccagcctgggtgacagagcgagactccgtctcaaaaaaaaaaaaaaaaaaaaaaaaagatacttcatcatagtcaaataatctaactgcacttgtgtgactgaaccgagagatgaattagacactttttttcaatgtcacaccgtaactatggttttgcgggtttgggttctttggcagacattttcttgaaaataaataaagtgaacctgacacttcaaggggaataactgacactatttactgccaataacaaaattcaagctttcaagcaaaagttagaattccgaatagcttttatctgtcatcttgggcttgatagcttcccaacacttaaaagacttttctgttgaaacccacggtgatactaatgaatgtgatttttgatattgtataacaagatgagttaacactgggaaaatctatacaactcattttccaaatgacagatgcaggatgttaagaaatcatatacaggtaaaagatctatttggaatacaagacagaccaagacatgaaaaattcactggtgttttcagattccacgttgcaatttactctgaagaaactactactgactgagttttggagttgtaccaaagaattatctgaaaaggccattgagatactcctctcttttcaactgtatcacctgtgtgagggggattttctttatatacttcaaccaatacaacatgctttaacaggctgactgcaggcgttcagagtctagctgtcttctattatgccacaatgttaaagagatttgcaaaaacagaaaacagtgccactcttctcgttaaattttttgtcttgaaaaagttatttgtcattaaaaatgtgttaggtaatgaatttgttatttaaataatttttaaaatttcttacatagtaaatattaacaaatataaatcacacaaaacactctttaggtgttctaaataaatttttttttttgagatggagtctcattctgttgcccaggctggagtgcagtagcgcaatctcggctcaatgcaacctccgcctcctggattccagtgattctcctgcctcagcctcctgagaagctgggactacaggcacacgccatcatgcctggctaattttttttgtatttttagtagagacggggtttcaccatgttaaccatgatggtctcgatctcctgacgtcgtgatccgcctgcctcggcctcccaaagtgctgggattacaggtgtgagccaccgtgcccggcctaggagttctaaataatttttataaatgcaaatagcttctgagttccaaaactctgagaaccactgtgattttggttcctctctcactggccctctagtctggctagaaactcacttacttcagaaccgcctctccctgagggaatctaaatttgggcacagaacttgctgttcagctttttctatgaacttgggattccctctcaattgcccaatcttattccttatagagggagcagctgatgagacctcctcaattccaaagtaaatcatctctctcaggaaagcaccatacatcaaagctttcacttaaggcaaaggagggacccagagaaagacaacctccagaggtcaggactggattcagagcaggactactggcccctcagaggtttttcccacgggtttgcattgacaccgtatctttaatataaaaaggagcacaggtgttttgtatctacatgcatggttttaagaattagaaaaattaattacagagttggcaagcaagtgaaatatttcaaaacttacctctttttgtattttaattatccaattttcattaatgaggataattttcaggctaaaacacacccacaaaattatttcataaatttcgcagatgagaaactactgctcagaaaaagctggacttgcctaaagccacaaataccatggcaaaactccagttagaaaacccttctcagtgggtctcacattcctgcacattttttgagtgaggcactaactgcccggttgctctggactatctttgcaaggatatctgcatagcgagcagccttgaaaaacagtcttcctctaaagcgaagggcagatttgcttactgtccagcataatacagatgcctctcttggggccgaaggcaagtctgcttgtggtccgttatccaaggttccagttttctaagctcaggagatctcagctatgatgcaaatccactgggtgcacagcatccacctgggccacttcacgccatccctcataggagttggggacaaaagagaaatgacgcaaacttgatgcttgtgctgcttgctgtacagtaagtcctttgtttctgatggtgttcaggagacactactcccaaaatatggcatcttggcatactgaaaattttacactggaggaatctgaaaaatgacgtgcaggtaggattttctgactgtcccctgaagcaggtcataaaagcatctcacataagaggtgccctccctacactcagaggaaagcaacatccttatctcagaagaagggacagagagaggaatctgaacaaaagacttgctaagtttctcctggcttattactcttcgttcataccccttgctcccatcatatttcttcacaactttccactcttcatcaaagctaacataaaaacactcaggttcaaccagttcttcggtattcattttcttatgaaggctcctgtgtcacctaaaacttttgtgaaataaaagtgtatacctttctctttgttaatctgtcttttgttacagggaccccaactaatgaacttcaaatgggtggaaggaaaggctattgtccctcccctacatctcagacccagaaggttcctatcttccaccagcatcagtgaaagtgtggcaggctaacttgttagtttcaggtccctatagcttctgactccaaacagaccacaaaacacaagtataagatgtacaatagccaaaaatacttcttaaacaacttgctacggcaaaggaggaattaaactgcctatacttgcacactctttctggaccatatccttggggaaaaaaacaataaggcaatagatagcaaaatctttcatctggtaaatttcactcctaggaattcacactatatcgggttccctggaaacagactctgagacagacatatatgcagaaaacttagcaggcagtgttgttcagcagatgcccttctaggaaaacagagaaagaaggattgggcagagggagaagataatgggcaatgtggctacactaaggcctcagccacatatgagagctctggagtcaggaatgcccttcagttgttccaagttgaggcacagcagctagatcatcattcccctacatggtctagccactggctaaaagtgtcccctgtgaggcagtgttaacactgaatagccctaattatcttcactgaattacagactgatacggctgacattaaaaatgggaaagtcgagactttcagagcacagacacatgcaatctccaaattcacagaatagttaagacaacactagcaaaaaaggatacacaaacataagtgagtagaaaggaatgggtgtacttcatatattcagatataaggaaatacacacaatggtgacaatcactgtgctttatgcctggtgttatggtgactgttttacatatattacctcatctacttctcggaatgtactggacaggtactatcatcatacccaatacacaaatgacacaaaacaggttaagtaactcacccaaggtgacaagtaaacaactggcggagctgggcatcaaacccaggtctgcctgacttcagagcccatgtgcttaatcaaccaatccattccatgatctccctatttagagtgttaaaaacaacaactcaatacaacacgtataccaaggacatgtcatccattcacccctccagacctacttcccgtcttcacctgtttctctggcctgggaggctgacttgaacgtaatgcacggaagggctcctttgctgccaggtacctggctcccttgctaggatgaccttgggctggccgtacccgtgaatggaggtagcagctcctgtaaggtgctctctctacacaacttatctgcagattcggtagcagctattccccacccacccgttgactctgcaagctcaggtggtaatcactcccactacacatgctaggaggtgctgcactgccccgaggggcccccctatgccccacccacaccttgatagtctctcctcagtctgagagtgtcatcttctcctgccaacatcctgagctgatatacacacctatacataaacaggatgctgagtaatggcaaaaaggcattatttaccttcccagaaagaaatgtaaaggtcattttctgggaataatatgctgtattaggggaaaaatactggaaacaagatagaaacagtcctgctctttaataaacaactggaaggaacactttggcaagtttacttaaggcataaaagtaaattatagctccagcagcaaaggtcccttcctccctgtgaccctgcccctggcactatcttctccctcctcaccaacatcttgcttcctctgagaagcagagaaaaaaagtaccttctcccgatccctcctggtgggacatactttctatctttagagaagggtatctaaccttcaaacaatgtccagaggtcagccaaatgaacaggggaatataacattccaaatcaaagcccaaacatcaggtacagaatggaaacacataaatgtgcctcaagacagtaagcagcatcttcagtcatttgaccaaagtttaagtaaaactaccatacaacagagcttactaaggtgaggaaagtatcagggaaaaatgaaaaatagcttccagaaggattcagctaaattaatggatgaaataaatccaacactccttcattcaaaattgttgatcaggcaccagccaagcttaggggtgggccagaaactgtctaccccagccttcagcactgactagctgggtgaagctgggcaagttaccctcccttaagctcagttcctcaactacaaagtgacagaatcataggaggcagttcctaagtttgctacgaagattcaataactacagatgtaaagtgtttagcccagttcctggtacacactatagattcagtaaatgttagctaaaatggatggtattacaagtagtaacaatttaaaagaagaaacaaaaacttctgacctgccttaaaatgctcaacctaatgaactctgtaaccgaaacaaaactggagagacctgaagtacacccctaatctttagaacttaaggtgatagagagaacattacagcttccccaaaggtctgctgttactatcagagatatgtgggctaggttccttcattcaatgtaaaaaaggacaaaatagtggctgggagggggagtagtaaaaatgtataaatccatgtacaacttctataggtttaatattttttagttgtgctactaaatcaataaactgaacagaaacaatttcatgggctttatgtcaccggaatgatgagttaaatttaccaggagtttccttctgaatgccacaagcatcatcagtatcaattttaataaacctactctttctctttaagctctggcaaatccaagtaccagtgctcttcactaatgattttcttttcttcttcttctagttgtttcttggtttctgagtccagtcccctttgcataaactgtgaaaacaaacaaaatcaatgtcagaaacttttcccattttagaactgaggaaaccccaaataattttcttcttctacttgttctccttcatttatctatggaacccatctcaagattgagggttggggcaagtgatcaaacggtttagctctacccttccaactttacactagacgatgagggcttgtgtcagggcatgagaaaatgcacaatgtatatttccttcggaaaacttaagggctaagacaccacattcgaaggtcttgtgctcacccacagagcccactggctttggcacctgctgatctggggttgaaatgcccttcttatcctcttccacctggccaactcctcgcccgtctgacataggtaaagctactagacttctatgagtgccagtaaaatcagtgcctctgtcctaaatgcttccatggctccctccaatagactcaccacatctgaactttctgagcatctatcttttctggagaccttaaggactgggtgtctgggtcatctccttcatctgtcccaatatgatgactgaagcacagtaagagcccgataaatgtaggcagaagcaaaggtacatctataagtctgctcttcgtttttatttttcctctgaaatgctgctaaactcttgagctgctcttatcaaatctgcagaaagttgactcaaaatatggcagtaaataacagtcctgctgccagtctctcactagcatgaatacctgtatttcttcagggaacaagtgaacaaacttaagaggctaaccacagcaacaagataaaatatcaacactggagaaaataaaatcagaaaatacccagaagcctcctagcagttaggtttcagcttccactggtttctatgtatcccccatttctttcccttattcaggtccgatatttcttttttatttttttttttattttttttttttgagacagagtctcactctgtcgcccaggctggagtgtagtggcacgatctcagctcactgcaacctctgcctcctaggttcaagaggttctcctgcctcagcttctcgagtagctgagattacgcgcctgccaccacacccagctaatttttctgtttttagtagagacgggggttcaccactttggccaggctggtctcaaactcctgactttgtgatccacccgcctcggcctcccaaagtgctgggattacaggtgtgagccgctgcgcccggcccaggtcccatatttctcctccttctattccaccttttccaaacataagcctttttaggcataagcactttaacaatgactactaagttaaatgaaaaaaccttaacgttcacgaataaaatagtcatgcactgcaaaatgatgtttggtcgacgatggaacccatatatgacagtggtcccataagattacaatgctgcatttttattgtaccttttctatatctagatatgtttagatacacagacaccactgtgttacaactgcctacagtattcagtacagtagcatgctgtataggtttgcagcctacgaacaacaggctgtaccatatagcctaagtgtgtggtaggctataccatccaggtttgcgtagatgaaccctatgatgctctcacaatgatgaaatcacctaacaatgcatgtttcagaacgtatccctgttgttaaatcatgtgttaagtaacacatgatggtgataacatcaagtgctgaagagaatgtgaagaaactgatcactcaaacatagctggtgggaaagtaaatggtacagccactgtggaaaacagcatggcagtttcttagcaaactaaacatacacttaccatatgacccagcaaccgtccacgcaaaatgagtgcgtgtaaaatggtgaaatctgcgtcagctcactgtcaatgtcctggctctttatcatatcctagtgttgtaaaatgttgccgctaggggaggtggcatgaaggacgcacgggatatccctgtacactttttgcaacttcctgtgaatctatcactattttaagtaaaaagtaaaagaaaacaagtttgcagactagtgttttgcagtcgtcatccattttacctgtgtgtacatcctcatcccaggaaagaactgcagtttctggaatgtgcacgctatacttcccagtccttttgcctttgcgacttaacacgtttccattttctgcctggcaaaatatttactcttttaagcctacagtgtgtgtcctttggtaagacttcctggttggcatttggcttggctcttcctaggtctgctcctataaagaagcacattctcaagacagcctcatcaacactggaatattgttcaccatcgtgctgctttggtgtctcccaggactacgattctgaatagaccatgactcttgttcatcttgtatcattggtacttaggcggcacccctggtacacaaaagagctcactcagtgaaagttctctgaatggaaatgaacctagacctatcttatttttccagattctctttctgggatggttttctttaaatgcagatgcctcatttcatcactaatattcctcgtggtaaaactcatcaatactgcccaactgcccttttttctcccatttagtcatgtacctattcttttggtatacaacagccatatacatatgttctgtacacatagaaaggacagaactccctgtgaatatgaatcaagcacctccagacttaggtacaagttcgattctcctactctagagcatttcagaacacattccaaaactagtgaggactcagagcaggcatcagcataatacagtcctcaggctagatgtctgttgtcgtcgataaagttttactggtacacaaccatggtcattcggtcttgaacaacactggcagagctgagtagttgtaacagagactgtctggctcataagaccaaaatatttatcatatggtcctttacagaaagtttgccaagccctgttctgagagtctaacagtgccaaaatcacaaataagcaccctctacaaccattccatactggaagaccttccatccacatccttctttttcttcttcccattaggatcaccctgcaatggctgaccaagtcagaggcattgaagtgagtcaggattaaatcctcaaccctcttatacttgcctaaaaagtggtccccaacctttttggcaccagggatgggcttcctggaagacaatttttccacgggtggtggagaggggaagggtagatggtttagggatgattcaagtgcattacatttattgtgcactttgtttctattattatattataatatgtcatgaaataattatacaactcaccacaatgaagaatcagtggaagacctgagcttgttttcctgaaactagacagtcccatctgggtgtgatgggagacaatgacagatcatcaggcattagattctcgtaagtagagcgcaaggtagatccctcatatgcacagttcacagtagggtttctgatcctaggagaatctaggattctgccactgatctgacaggaggcggagctcaggtggtaatgcaagctatggggaacagctgtaaatacagatgaagtttcgctcgcttgcctgcccgctgctcacttcctgctgtgcagcctgttccttacaggtcatggactggtgctggtccatggcctggcggttggggacccatgctatataggacttagctctggttaaggcaccctaagtgcagctactccatgccttctcacagtatactctgttctatcagtatagacagtgtctcctgctatcttgccagtaagttttttcttatcaatgaccaaagctgctaaaccaaatagagaatgtgggtgatctttttccttctcctttgcttccaacgtccagttgagtctccccatttggtgggggtggacatttaagttaatttctttcttcttagttgcaactcggatatttagtttgagcctgagtcacccagtacatcatctggcttattccaagagctaaaacaactgctaaaatctttccaatatctgcttggccaattcactccacttctctgaagttaatgttattaccaaccataaaatcaaactctgttcagtaaagattcaaattttgctaatatgcatgaaagtgcttgacaaactctaagttatgctgcaatttgtcctccaccctcattcacccattcatccctaactccatcctagctcaactccattcaaatcttgcccatataatgtttactctctctcttttttttttttttttgagacagggtctccctgtgtcaccaaggctggagtgcagtggcgccatctcagctcactgcagccttgatctcccaagctcaagtgatcctcccacctcagcctcccaagtagctgggactaaaggtgcgtgccactaggcctggctaatattttgtattttttgtagagatggggtttcaccatgttgcccaggatggtctcaaacacctgggcttaagcgatttgtctacctcagcctctcaaagtgctgggactacaggcatgagccactgcgaatggcctatctttcaaaacattatgaatgcttccttccctcttttggaaattccacctctttaaacatgacatgtaacagtttgctactctctagaagtagtgcttagtgacaggcatcacagagtacagagtagtaataaagagccagggttctggagccagactgcctgaattcccgtcctgtctacactacttattagctgtgtaactttgggtaaattacttatttctgtttcagttgccttagctgtaagaagagagttactgcctgtagtcacctcaaagtgtcattatgtgaattgcataggttaatatacgcaaaccacttcaatcattgtctagtactataaatatttgccattttcttgatactgttccccgtttcaatagctttccattgctcacaaaataaaggaaaatatctttaatctggcctcaaattccctgcacgttgtgaccattgcctactctgcaaccccatttcttagtacttgccttccagacatactgaattgtctctaattcttggaaatttccatggttttctttttctttcttgcctctcagacttctgaactcagtttctcctagtttaggacgctgtgccttccaccctcccagtaacctagagactaccctgcgagactcaccctcttctccctggaagaagagggagttctgccagcagactgtctttggacttggactgagtacttctctgggtctccagcctactggcccaccctgcagattttagacttgcatctccacagtcgtgtgatccagttttaaaaataccccctctctccatacacatatatacacatatacatcttgttgattctgtttctctgaagaactctactaaaagaagtattatcaaaattaaaaaggagcttgaactcatgtagcctaatgctcttctttttaaagatgaggaaaagagatattcagagaaagaagtgaatttacctaaattacccagctaaggagttacacttcccatatatcatatttattgcatatataagtaagcaacaacttctcgagaagctcggtgagtccccaaggtccccagcgcttctaccctcactgcactgggtaagctgtaccctgactgcttctgtgtactcaagctcccatccgcccgcgggcctcctgagagagtcggcctaattcgtaagctggttcccagtaaacagtgcagagcaggcgctaagtgaatgaatgagcacgagagctggaagccctctgaggcctctctggtgtcccttgtccgcccgccgcctcggccccggccaggttggaaggaccgggtgcccctaccgcccggagtggcgctctcagcgtccccgcaccttcatgcgcagtagattcttggacaaccttgtctttcgctcggccgccatggtagcttccgcccagcgccgcactccggccgcgagcctcaccgcacatgcgcggagccgcgtgcgcagctgcgtccctcgcgtagtgcgcgccgccccgccccgcccctcccctgtgtcttgcgcgcgggcgcggccactcagcgggcgctctgctgactgagaggctcgggtaagctcgcggggtggcgggcgcggggatgagcgcggcagaccgcaaaaaagccgaagtcagaggacgacccagaacttggcttccccgagccgcgggtcgccttcccgggacgtcggcctggccccctcggaggcccatcctccctcggggactcccttcctcagggaccccctccacactcagtagtcctcgccagcctcagagaggtttccgccacgcctgccacccgcctgggccgtgttacccacgtgttttgtcttcataacgtgggtggcgggctccctttgttctgggtcgctttgcagggtccaggtcgttttctcttcaccaggaccccacgagttgctgctttcctcacagcagcccggagtcccgggggagcgcggcgggggccgccccaggcaggctggcttcattcccaggctgctgccgatgcgtgtctggccgagtgatctctgctaaacagaagaatctcaagaaatggcaagggatggaggcagggatgggtgccaaagacacatgaatgagaacaaagcctggttttgatccaaagaattgaaaagaccatagcgaggggcaacatagggagaccccacctctacaaaaaaaaaaaaaaaaaaaaaaaaaaaaaaaatatatatatatatatatatatatatacacaaaaaatatacaaaatatacatacaaaaaatatatacaaaatatacaaaaaatgtacaaaagatacaacaaaaatagctgggtgtggtggcacggatctgtggtctccactacttgggaggctgaggctggagaatcactggaacccgggacgtcgaggctgcagtgagctgacatcccgccactggactccagtctgggctacagagtgaggctttgtctcaaaaacaaaacaacaaaacaaaaaagaatttaaaaaaccactgaaaatagggtagcgttcctaccctggtgtttaatgctctgggtaccacctaaacacgttttcgaaaaccattcccaggtccgacgctttggaacaccctcaagctaatagcatctcggctgataccatgagttctacgtcagattgttgacctggtcaccttagggctaattagttcacttaatccccataagaaccggaaagaaggtattgtcatcgtgttgttaaggattctgagacacagagtgggtaacgcacttggtgttcacacagctaatccatgttagagctgaaattcaaacaccgatttggatgttaaaagccctttaggttttcccaggggtaaataaaatcattgtaatgtaccaagtggctacagaatctcattcacttgtgactgtgtgtgagatgccgggggtataatagcgtgtaaaaacacatatccccacctttcctgaagctgatattctggacgtaagtaagtggcgactgctatgaaagagagaaaacagtgatgtgacagagtaacgcttagggttactttagaccaggtggtttggaacggcccttgtcagatgatggtgctaaggcttgaaagttgagaaaaacgtgttttatgaagagttggaggtagagtgtgctcagaagacagcatcaactgtaaaggtcctcagatatgaacaagacaaagtccgtgttaaaagttttacaagtggaaacagtagaggttaatcataagccacattgcatcccccaaaattcatatgttgaagttccaactcccagtgcctcagaatgtgaatgtatttggagacagtcctttttaaagaggtgattaaaacaagacccttagggtgagccctaatccagtctgactgatgtcgtcataagaagaggaaatttggacacagacaccaaggttgtgtttgcataaaggaaagactatctgaaagccaaaaaaataaaaaaaatttaaaaaatctctcaggagaaaccaaacctgccaacaccttgatcttagacctctagcctccagcactgtgagaaaatcacaaccagtctgtatagggcacccagtgtgtagtgttttcttatagtaaccgtagcagactaatataccatacaattagctgtagatgacagttgtgatgagagcccggtaaggaaagtttgagggtcatgaaagggtacaacgagggtacctaaaccattctggcctggaaatgaggactctcctaaacgtagagaggagttaatcagggaaaaggcccaccaatcattcacattgttatgctgcttttaccaccataggactcttcatcttgcaaaatgaaaactcttgttcccattaaacactaattcctcaggtcctcacgactactttctgtctctataagtttggtttttctgtgggattctcaaagaactgctgtgagagtagaggtgaagggagaagtgactcagtctgccttctgcacttgggaaactaaggggcgactgaactaggatgaacacatgtcttgtcagcttcagaagaggaaaacagcattcccggcgaaataagagcatatatctatcatgtaaggatgctggaagcgccacaccttctctatggacccctgttgtaccagtctgtgttctgatttgtttttctgaaacattgacattattatgttattctttcactctaaaatttacaatatctgttattgtctgagagataaagctcaccttcttcaacctgccactcaaaattctatttttctatttgatggtgaaaatccttataattaaaatgaatcccccaagtcttttcccacccctcaacatgttataaatgagaagtgatttaagagtaatagtgtaattttaactttgaaaactacctgacaagataattccttgatctttctatgcacctgaattgcagagcacagaggatagatctcacaatcaataatgtgttaacctgttgtagttacccagccaaagaaacatcattttgagggaagaaatgtttcaaataggtcttcacacagttttgagtcctgtcataatggaatttgttggaagtatgaaagcctccaattcctgccaactactatatccatcaagaaaaggttccctgtgactcttcactcccatagcagatctaaggctgtggtgcctagtgcatagatgcttgtcatatgtgactagtgagcacttgaaatggggctagtgcaactgaggaactgaatattttagttaatttaaattaaattttattatattattattattattattattttgagacagagtcttgctctatcacccaggctggagtgtcgtggtgcaatcttggctcactgcaacctcgcctcctgggttcaagcaattctcatgcttcagcctcctgagtagctgggataacaggtgcccaccaccacacccagctaatttttgaatttttggcagagatggagtttcaccatgttgaccaggctggtctcgaactcctggcctcaagcaatctgcctgccttgggctcccaacatgctgggattataggcttgagccaccatgcccagcaatttaaatgttaaaagtaacagtgtgagttatttttctgtatatgaggctatattgttttggaaggaacatatatcactttaacttttcaaaatttagcatctgcattgagatgtgctgtaagtgtaaaagacataccacacttcaaaagacttactctaaaaaaaatctcaatattttttcatattatatattaataataaagatatatttgtttaaataaaatatagccttaaaactaatttcatctgtttctgtttactttttaaaatgtggctgctagaaaatataaaattacatgtgtggcttgcatttttttcttttcttttttttttttaaatactgcaatggctatgcataccttcctagtgcagaaactggaggagaatctggggtgagcacaggaaggaactcttttatgcaatgagacaatgaaggtggtatattaagtattagtttttgttcatttgtctgtttgtaggtaccagatattgaaaagacttgttaaacaaaatggtgatttagaaggatactgggtagttcataggtgttgagaaggcttgataacaaggctaagttaaaagaacagaaaccagggcattccaaggaacttaatgacacagcaagaatggtgagcaccaattgatttctctgctctttggacactttactcaagttttcaaaatcaaggagagagttttgttatgtctcagctaagggagggcaggacctgatttacaatttcaagaagactatacacaatgggggagggtaattctttaaagagaaattgggtgctgttcctcagagatagtcactatactagccacaacagcaatgccaaggacatatccacttaaagcaggatgagagttctgttgagacagctggaaggacagacaaatggttgagtgtgagttccgaactcatgtccaacatcaaatccatctcgcaaaatgtgctccctctttctgcttccctgatttattcatcaagtattttttttttttggctacctgttacatgcaaattgttactccaggttaaccagcctaacaatgtagtagtataaggcattccttctgctcttaccttcggttacttattaccttttcgtggatgtcttggttaaatcagaacattagtactggaaatggccttatatgacatctaggtaattcctaaacatcagtaagttgttatgagaaagatcatgaaaaattaaaacacatcaaaaccaaaaacattgctgattctctggatgattctgatgatcagccagtatttggaaactatatagagttagctggaccttttaattatgtataccaaattatgtcagctcagtcagaattgaggtttgttagcattccacctagcttttttttttttactgtgcctccatccatcccttcttttctgttgctgcaagcctatcccagaatttatgcctaaatcttactatgttatgactgtctgattgccataggctcctattttttgttctgccttcttcattttttattcttttatttaccaaaaattttaaggcatctcttatgtttctggtgctttgttaggtactagggaaaccacccccgccatgggtatgcccaagacaacgatatggatcctaagtactgtcatagagatggaagatgtggaaggcagcataatctggatttaaagcgctctgagatccatccttgggaaagtgacagctaagccgaaacctcaagatgagttacacgtttgtgagacaaaaaaatggaaaggggcatggaggagtgaagtccaatagaaaagggttaaagtgatgcttgttgtataggtgacaagtctggggaggcaagttacggccagatcttaaaggccatgtattaaattggtaggattttatctgaaagtttctgcaaggctattgaactgttttaagcagtagagtgacaccgtttaaacattgcacaatagaattgtgtgattcttaagatcactggctaaagtggagaagggaaatggaggaaggaagaacaaagcagaagacaaggagaaagcctgaccctcaagccattttaaagattattttagattacacttcgtaatttcctgtagattaatcttccattttatctagttcatcctatcacctttgagataaaatccaaacccaggtcgagacttgatgggtaagactttctacacctgccttctagccttatcttctagcttttcatctgtcttatatgtctcaacgtactctcctctagccaagttgatctacttactgtccctccaaacattccatatttatccttcatataaatttcatactgccttctcttctggaatgatgcctggaataatgtttttggtgttctttcaacttttcaaatcctactcctcaaggcccaattcaaatttcaccttcttcttacatcaactgaaaatgatgatagggctgtgttatagtttcagtgtttaattacacactacgtttcattgttaactaaaacgatttcaggtgcaggaggacaattctgggttttatactcaccttaaatgtttcacagctttaaacacagttcttaagatactaaaaaaacacttattgaatgaataagtgaaaaaccgcctgctctgtaaaatgggtgagacagcatttaaaaaattatatacatcctttaataacttacaggccccacaatacccaacaaattccatccagctgagttgacaggttttttaaaaaatttttaattttaccaaagaaaattaaagaaatgaaaagtcaaggatgaggtaaaaaaacagcttattttcctgtactaattctatttaaaatgttattttcagttaaaaggtatgatatctttggcctgtgaggaaatttctaaagaagccagttgctatggggattatgaagagaaacaatttaaaaaacataatcaattcatgcaaatgaagccaaaaggtctaaacctggaagacatttgggagggatggaggaggttctcagaaagaggaagcacatggaaatgaagtgttaggggaatatgttataactggaaacctggccatagctgacatagggttgttactttcccaaggaaagggagtaattgtcgtatttactaatgagaaggaacaaaagaaaggtcttaaatcagaggactggagaggccaaacagtcttctctttacctacaacggatccttactcctagaaaaggagagagcaggttatagaagccgttgccagctgaaaagaaggctgctgggcctgtggactgagtcaagggctcttgctctcaccttcctatatccctctactactctaagaatatgcctcccaccattaaaaaacagaaagccaatatttttcttataaggacagttacatgtctttaagttttgttattttatttattatttatagtaagtttttttttaaattcttcttttattagttgtgctgggaaggcttgtttgttctgtggctactggagagctccacataagccgaattcaagccatgcaggtgctcacagcttttggagaaggataccatcacatatacctggacacaaatcatcccggcacattccggtggtacccaggcactgctgaccctaacaatgagacattttctctgtttcacacagcagcaggggctgaaaaaaactctgcaaatccaatttactgttttaaagaaaactaaatttatgaaaatgatctctaggggaagttgtacggtggagtggaaagaacataatctttagaaatagaaagacttgaatttgaatcttggttctaggatttctagccatgaaagcctgtagtaagttttgcagacttaaaaatgcattttgtctttcggagaatttttttcctgttacaactttaaaatagaaacaaaaaactgttctcctggattacgacttgtatgctgagaatatgcctgaaaaatcaaaggcaggtgcattaaaccttgcatactcaccagatggcgtaggttgatggaaagtgaattcttaatcctgatgctgatgttgaagactcctttatcccactggtgttcttaccatagttagaaattgctggcctaaagagcatggacaaaccagggcaggggttttcgtgacaaaagtgaataattaggaatcaaagttctctttttaaagccctgtaagttattaaggaattcttacgtttgtagatattttgttagcaatgatgtgataaagtggaaaagaatccaattagatattagattcatttgattaaaaaagattagtttccaaactatgatatatatgtgtgtgtgtgtatatatgtataaagaaatgtacaaattagaaaaatgaaagtctcacctacttcatttccccaactcccattccttaggggcaacttccattaaatcttctggcttcaaaaatttgcactaaaagaatgctctttaagtgaacttttttttctgttgaattgttttaagaaaagtatctgtttcttatagtaagaaggcactgcaaagtgctataattgtttttccttcttaaatatacctacaaacaattgttttgttatattaatatttctctgctgagtaacatttggccaagacttaactaccaccattggatggcagcctaaattgccacccctgaggaagtgaattcatccttgacaataggttccataaaatccatcttacaagtgacaggtttgcacagatgtttttaaatgaagtgttgaataaatggttcctcttgtttctagcaagcatgagagtgagagagcgagtgagcaaaagaaatgactagtgaccagttgagaaagtcctgtcttccattgagccatttcactcctgcccatctactctcaactgctcaagagccgctgaaccctctgaacactgtgaggatcagatgagacaacgtgtgtgaaaacaccttacaaatacaaagctgtgaagatgtaaaggatggttattacagaatggaggtagattgcttctatagtctcttttattggcatggtggatttttaatggagtagcctgtatgaattaactaccacaaactaagatctgtactattggacatttttattttctttaaatccacttaaagttaaatctaacatctaattatacttatgggctggcagaaattaaatttaaatatttattagtgatgtcctgccccaagcatagtccaagggttcagggtcttaaatgatgccaaatcataggtgaagatctccttgtcattgatcatgaattatgtccttatctcactgataatgcagagatatccattttccattcatcttaatctttttagattctgcttctcccttgcttccagtccacgttcggtgtcacaaatcttcgagaggactggaagtctagcatccaacattactgcgtgcacaatacagacactgtttgccttgtaagattctttgtctcactggatcttctgaactctgacctctacccattattgaaaaaacttattcttcccttttgctgccctagaaagtactgtctctcctgtctgcctctgggcatcagggacatacctcttcagtgtagacttttacaaaagccaagaggagctataggattcaggcagttcccctctatgtcctataaacctcctctcctgccccagagataagacgtacaaagtgcctggccaccttcctggaagtgttgaggtgtgcatagagtaaaacatgaaactcaaaacattattctgctccagtggcataacaaataacttctcttggcttcagcatggcaaaattttggtgaacacactccaggttgtatgtgtcctcctagctggatgaacagaacactccatgtgatcttcttgatttcttgactgtacctagactaaacaactgtttttgttttttcatctagctgcaataattccagtgtaagaggaaaaggaaaatacttcattaactctaaaaaaataattataatagtttataatttgcatttgttgataaatagctcccttaacattggtgaaatacaataaccagcttctatggtttcgctattgcatttgaatttttatagcatcattcaaactataagaaagctgagttgcatttggtttgtgctgcttaggggatgtgtgttaggaatgattagtcttgtagattaaattattatctaaccagtcaggaggaattaattgctgtggtttaaagatatggctatttggcatttagtagatcagttttaaggagggaaactgttaaatctttttgctatggaaaatttcaaaaatattcaaaagtacaaagaagagaatactttaatccctacatggtcatcagccagcttaattatcaatttatggccaatcttgttttatttatgtttccaagttttcctctttccatccctctttcagtttgaagctaatcctaggcattgtgtaatttatctgtaaatattccagtagatatctctaaaaggtaaggacttaaaacaaaacataatcccaatgccatcatcacacttaaaagctaagcaacaatgaaagaacactttttaatgatccttctgttttcatcatttatcttatcatttatctccttatcatttaaaatttaatattagattatgtcaacagcagaaatctatacctactaacatattatgaaagatatgcaggatacgttaagtgaaagaggaagtagcaataaattctataacatggtttatttctattttaaaaattataaaaatgaggctgggcacggtggctcacgcctgtaatcccagcactttgggaggccgaggcgggtggatcatgaggtcaggagatcgagaccatcctggctaacacagtgaaaccctgtctctactaaaaatacagaaaattagctgggcgtggtggcgggcgcctgtagtcccagctactctggtggctgaggcaggagaatgatgtgaatctgggaggcagaacttgcagtgagtggagatcgggccactgcactccagcctgggcgacagagtgagactctgtctcaaaaaaaaaaaattataaaaatgatatctatatttgtttaaatttgtaaaaggttggaagcatatatcgcaaatcaagaactgtggtatttaaagtaatgattacaattgatattgtgagtagggaagagactctcactttaaaacctgcattaacaaaatctttttctaaatatatatatatatattttttttttttttttgagatatattacttgttttttttgagacagaatctcactctgttgcccaggctagagtgcagtgatgcaatctcggctcactgctataaaaactcaaatgcaatagtgaaaccatagaagctatggaagtatttcactcactgcaacctctgcctcctgggttcaagcaattcttgtgcttcagcctgtgagtagctgggattataggcctgcaccatcacacctgactaattttttgtatttttagtagagatggggtttcgccactttggccaggctggtctcgaactcctggcctccagtgatccgccgagctcatcctccgggattacaggcatgggccactgcctggctgaaaatgtatattactttccgaattaaattttcaaaggagaattcatgaaaggaagaacttgcatatattttgttaaaatgtgaaatgagagacattctcagggcagggtgtgctatccaaatattgtccctcagttggatgatcttactcttgggttaataggagtagcagctggcatgtatagcttgctggccatgtgccaggcactgggataagtgctttcaagctggtgatttatttgtcaccacaaccctttgaagtaggtattgttattattcccatttcacagattaagaaacatgatctactgaaatcccagtgcttggcttggaaggctaagataggaggattgcttgaggccaggaattcaagaccagcccggttaacacagtgagaactcatcactacaataaaaaaataaaaaataataataaaaaaatagcaggtgtggtggtgcatgccagtagtcccagctgcttggaggttgaaatgggaggattatttgagcccaggaatttgaggctgcagtgagctatgattgagtcactgcactacatcctggggtgacagaataagaccctgtatctaaaacgaaaaaagaaaagaaaaggaaataaaagaaacatgatctagagcagagaaattacttgccagaggtttggaagagtctgacccaggcttggtcctgagctggtgggactccctggccattgctccactcacttcattgatcattctgcttccctgggttctgaagtctcaatattaccaaatgaattttgttatttcaattcatacttgtttgcctcttttgttgctgaattgccatattatccttattttattatgaactcaatggctcagacaagacagagtagtaattcctcccattttatcccttgtccatagtatctgattggcctgaaagatgaaagggagaaacaacacaaaaggaacttcatgccttttgtgatttaggaaacatttacatgacaagcaggtggttcttgtcatcaatggctttttgtattgtgcctcagctgcctaaagttttttgtcagtggaaaatgtcataaagttccttttaatttatctattccataaacctaggacaaagacatagcaagtatatgggaatagaagtgcacagcacttttatttggaatacatttcacattatagttgtaaacaagctgttactatctttttaagcaagttgttatggattagcccttgcatactgtagcaaatttatttttcacaacttgaccttagcgtccacaatgctttggaaccttttggtcatcttttgttcaggaataacaaattaactttattatgtaatataagaagaatgggattgcaaaacaaaatccacaaaacgatatgtccacgtacacacaaacacatattatgagacatgagttatttgcatagtcacactattatttcccttatctattggagataattgagatattactgtacacccaaaagggaactgtctataccccaaagaaaattgatcgttaacagaaagttggctgagttttatattccagtgattgtttcagaataaaatgtttctatcttttgcacttctgtgccatagccattccaccaggggccatagggactgggttgagaaaacacctctgaccaggacactttccagaacttagaccactcaatgacgctcttgacacatagtgagaaagtacatcaaggatgaacttcacagactgcaggaagatattgcacaattctgcttgtatccttaacataagattagatactttagtcatttagattacaaatttcactcttcagataagctgaatggtaggcccttctagtgagtagttagttcacagtgtttggagaaaaaaatttaatattaattcttctgcaaatgtatagatctctatgcctcagtttgggtatagccaaagaggatattttgagaaatcctatgaatactcataattatgtttggtgagatttttcaaaataccttaattctgactctttaggaggctcagagagatgaaagaatttttgctctgagtggaaagaattgtccactgtttattgtcatgaaacattatggtgtgctttaaaaaatatttggttaattcaggagccatagtgtaggaaattcagttctgtagcctatcttctaggtgggtctcccgccagtgtctgggataccttatgaatttaggtctcataaactaacattttccctccaaggggatgtattttttctgtgacttatatgtcatggttggctttttcgttcttccttctgatgaattaccttgcagttgttgttacttagaaagtccagaggtgggtgttcagttgtgtcataaatgtaatcttttttttttttttttttttttgagacggagtttcagtcttgatgcccaagctggagtgcaatggcatgatctcggctcaccacaacctccgcctcccaggttcaagcgattctcctgcctcagcctccctagtagctgggattacaggtatgtgtcaccacgcctggctaattttgtatttttagtagagacgaggtttctccatgttggtcatgctggtctcgcactcccgacctcaggtgatccgcccgcctcagcctcccaaagtgctgggattacaggcgtgagccaccgtgcctggctcataaatgtaatcttaatataaaccatatggcagaggagattgtctgtaaggtcatggctttcatgacatttttagtgttagggctggaaatgttctccaatatctcaaattcttaattcattagaaaactgtaaccacccccacctcccaccaatttaagcagctagtgccaattccagaactagagaggtggtattgcaccacaattacgtgctttggctctgaagtcatgtggtctgggtttgaatcttgcctctgccacttactaactgtgtaagcctgcgcaagtgaccctgtgccccagttttgtgcttcagtctgaaaatgggataatcatagtacctcgtttacagagttattgggagaattaaagaaacgaatacgggttaaacacttagcaaagtgcctggtacatagtgagtactctataaatgctatcagaattagaattctgtttcctgcctctcagttgattgctttattgttacgccacattgtctttcccgacttcccttaaacggagtaaaatatttcaatagtattatttctcattggaattgattaaatattttagaaaagagcacacagttaacaagtatcgttgtagccattttttctatatgggagatggtgatatgttaaatgaaaatttagaatgaaatgaaaaatgtaacaatgtatatctgaatatattcaggtaatgttatacaatacattactttttaatacagccatgttccctaatttgcataacaattgaccactttagtagcccattagataaattgagcccaattaaccaatttaagcttattacaaatgcacgtctgtaatgtgaaactgttactggaaactcattggaactcaactttccagtaaaaggaacccttgatttttcaataaaagaggaaatatctattttgggtccatgtacatgatatggatttagcaatgatttgtgcttcaattataatcacttactgccttttaaagagagattcatgtctttccagctctctatgaagatatattgctataacaacaatgactaatcttagatacatgatactgtccacctgttaaactgtgtcaactctatgaattgagccatagcatagtgagttaagctctgatctatttctattaggtatatgtggttgatacttcaggctgtctaccccattgtcattctcaccagccttatttgttactggtagaattctaaattttctcaaatattgtgtagtaatgtattttaggggaagttagggtttccatcagccttgagaggaggtgaatattgaatagtctaaatcagacattctaattctaattattacccttccgatgattgatttagacatggctttgtgatataattttgtccaaaaagtattgaggggcagtctttggcttaggcgtatggtgcttctgtgtaaaatttacacttagaagcaaatgattcggcctctgacgattgtcatccttatatgatgcctggaattgcagaagccatcttaaggatcttgaagaaaaccagtctcagagggaaagtcaacatgcttaggttggaagagtagtaagttgtaaagaaggtttcttttgacatcagtgaattaccaagtgaactcaccatggagccactctagctctggacttcctgctttgtgatatcataaaagtcattatttaagctaattctagtttgtcttcttttatttccaacagaaaacacactaaccaaaaccatgtaaaatcacttcattataattctgggttttctttgttctttgatcatagttgtcagaattagctggtgatgctgataggatcaggcataacatcgcccttgtctcttgtgttttcacttgacagttcccactatttcaatatttgtaaatatttaaacttatgttaaccggtgacatttctttattcttgagttagcattttaggtacaatcttataaatattaaataataaaattaatctcgtaggattccttttgtgttgcagtttcctttgcccctactaagctccttggatacaatcattttttagcacagctcacttaagggtatcaacttgaatgagggttacctcagtgagcacaaggaatgaggtaaaccttttgttacattaacacaaccatctcctttgagctgacgtactgtttttctaacatgaatgcttaatttagatttcttaaaattaagttttctctttttttaaaggtgatgagtacagaatcatggaatagcagctgtggattaagaagagtgaacagggctgggtgcggtggctcacgcctgtaatcccagcagtttaggaggccaaggcgggcagatcaccaggtcaggagatcaagactatcctggctaacacggtgaaatcctgtgtctactaaaaatacaaaaaattagccaggtgtggtggcaggcgcctgtagtcccagctaatcgggaggctgaggcaggagaatggtgtgaacccggggggcagagcttgcagtgagccgagatcgcaccactgcactccagcctgggtgacagagcgagactctgtctccaaaaaaaaaaagaagaagaagaagaagagtgaacatacgtgaattgagattggtgttgtgttaaatgaaacaaagaaataatttgacatatatataatatattttttcagctggatgaatgattactatacatagatgttaattgattcatgtaaatcaccagggttacagtttatgggagccttttaaaaataagtgcaattacataatgaccaagtctgtagggaggtcttaccgcctttagaaaatcatccttcctttcattcctgaataagtcactgcattttggctactattattttacctgtccgtaccatgtatagttactgatatggtttgggtctgtgtccctgcccaaatctcatgtcaaattataattcccagagttggaagtggagcctggtgggaggtgattggatcgttggggcagatttcccctttggtgctgttctcatgatagtgagagagttatcatgagatttgatcatttaaaagagtgtagcacctccctcctgtctctcttccttctgctccaaccatataagatgtatttgctttcccttcatctttgtcatgattgtaagtttcctgaggcctccccagccatgcttctggtatagcctgcttaactgtgagccaatgaaacttcttttctttgtgaattatttagtttcaggtgtttctttatagtgatttgagaaaagactaatacagttactgacagaatagtatccccattcactatgtgagtaactcttctttaaatgttgtggtttcatctagagatttatcttctgacccaccaaggaccaaaccatgaatgtagggaatggggtttcatttaaaggcggcactgtgaagtcaggtatttctgtcagtctttctgtcagcactttaggcaaagcaaattggaagtgaactgaacagatgggacctgttaagagagacccttaggaaggtctccaggtggggccgcaatccttaacattgccatatagcaaattcttcttctcttggtaataaatagactaacagaccatgattatttttcttaatcaaagaaccaaactcctaagcctttttttaatagacagcctgctttatatctacactgatgaagaaaataagaaatatctaataaagcttaagatgtatatctgcttatgcttaaagcctgtttatttagaatacctctgcctgctagcactttttagtaggtatgtctggagagagattggtgagaaactcactccttcctgtccaatataaggcagaacaaaggtgtgactgggtgtcaatgtcactgtgggttttcaatttctgctgatagaaatgtaaaactttctcaggagtcttggttttacatgctgggaaacccccttccaactcagtcctcatagaaacttaccggtaggggtgaaacttttttccaaactccatttcactccctaactgagcaataccaggtttacatgattagaaattcccatctttaggcaaaaatactggaagcagtagaataatactgagatattgttttgcattgcatttgacaggaaataagaaacatgtgaggtccttttatgagtctctatcttttgacattctgaaatttcttccttatcatgatattaagaattaaagaacactttctgctgaagatgagagatagattcctaattttgtaatatcgtagaactagcactaatgccagcagtctcagattagtcttaaatcactaactcttttgggggaataaggatggggatattcttattgtataagaatcttgggggtcagggggtttatgtagctattgtgctggactgtataagcttgactgcttttacgcatcttgcacaaagtgaaataataaaataattttgaaaatttttgtctatctcatttatgttaaggactgccaaggaaagtggggtgtgtgtgtgtgtgtgtgtgtgtgtgtgtgtgtctgagggcattgggggtggggtagagagagagacagagaaattccacagagtggagctgtgctgaaatggccagcccctgtatcctcttggagaagctccttcaagtgctgaaaattctgcatttcattttaataaaggaggtgaaattcccaatgtagtggcacacacaaccccatttaattatataatagatcatgttatttttcacacttgagtatttttacatgttttgcaagcatttttccaaatccagtttctactacagattgtaaccccttttgaggaggcagatttgtattctaattctttttgtattcttgcacagaacgcatattgcaaactgcagggattcagtaaatcctgataactagccagttttaacttgtagatgagacagttctttaaaggttacgaaaaacttcagcaagtagcagcaggagcagtcgtaaacttttttcttaaggaatacatttagggaaggatgtgaaaatatttcagttgtcttggtagcattattcctatgatttccacttcttaaagaaggtaacaatagatgtaatttaagcgctttagctgctgtcgtcatctaatctattaagcacataattgtccagtataccctttctttttttacatcccttgtggatcatacctgcttcttgtttggttgtttagcatattttcattgttagttcaaatgccagttttcctgcccagtcaagtaaggtgtaaagcacagagggagctgcatctttcaggtgtcaagacttctctttctctttggctcttttgctccattctttttggcctccatttctagagtgcacacctgccctacaattagcatttaatggcagctgtgaggctcatagtctcagacatttgcaaggactcaagactgcagctgaaagaagcagcaagcatgccaaaattgatagatttctcttgccttaatgaagattacagatggaaatacttttttgcgtgtgtgtgaacatgctgggatttgaggactaatgctattaatcaatgtgtactaaaacagaaacagttgcaaatatgtagtatagagtatcaatggaatagaaaacaaacctttaactaagcctgatttttttttaaagttggaaaatgttgccagcctgttttgatgtaattgaaaatgtttagaagctttcctgaagagttgattaatatatcaaaatcagaaaaggcaattttgagtctaattttgtttgtttacattgtaatacaggattcttggctttgaaattctgcggggtgaaaaatgactgtcagtgtgaaacaaagtagtctattgaaaagaacattgtgtctaagtctaatagggaacagctgataccagcccaatgcatgatatccagaattacaatatcttaatcagtctgaatagttccttactggtgaagtagagtccagatttggccaagggggagtctttggcccctcacctcttagtacaagaacccaaaatagggagttggtggggagtcactctggtccagggtggaggaacaaggatagtttggcctcttgatgagctgcagactagaacatctgctgtgtgcacaaaggtggaagcaaagtcatgaaggaagggctagcatggctcctgtggtagggcctggaaatcttgatgatgctccaagaagcttttccaatgacttcttgactttcttaatgtgaatgagctagattataattatatttgtaattatattttggcactcagcctttggaggaagaagtattagttccagaaaacttgctgtgcaagaaaaaaaaaaaaaaggaaattttacccagagtttctgccttcttggttgaaacatgagtattcaaagagaagtaaatgcctgctgtagtgtgatttcacttcttcctctttcctggaaagttccaatttcatatattttccccattatttcatcactgataactcctagaaacgacgatattttggtggttgtacctgctagactgtctttcaaatctggaagcaacacaaaaagtcttttataggatcataggtcttggtttggggttcagaaactaaggtcaccacatgtaggagatagaactgaaaaaacaaacccctaaaatcaacctaatcttctacccctttgggtagatactagagtttccagcccagattgtgacacagcctctgcttgaatatctcccctaatagattggaaactcacttataccggggaaggcatctaattattagtaagctttgtatttttaatcaaacctctttcctatagtctcactcatcaggaacaacagagaatgttttcttattttttttgacagttcttcagatatgaagatagatatcttcatatctctgagtcttctctctcccaggccaaggtttaccaagccctttaatcatgtcattcataatgagattttcaccattccaggggtcttaacactattttaactttcattttcctggtctagcttttgtagaataaaactggaaccctcttcccttaaaaaaattcatgataatgcagtttaagattgttttagttcattttacagccacatattactattggtttagactaatcttgtggtcaattgatgcctcttggtctatttcaaataaatgactatcgtcacccccttctccccccttccccccaatccgtgcatatgatgcttagaattggtatatggaacttcatcttcatacctaatatatatatatttttgaattctggcctgccattcaaatctcagactctcataaaatcttgattttttttcatctgatgtactagtttttccagtcagctgcaaattaaggtaggtttctcatgtttttataagtgttatcatcatcttgtaaaaaaaaggacacaatttttagtgagacagatctcgaattttaatcccagcttcatcacgtaactgctgtctgatgttagccacttatttaaactccctgaacccagttttgctcatctcaaagtgaagatgataatttctacctcttagttttgttgtgagcatctccaatagtgttagagcagaatacagtgcctatcacatggtaggtaatggtgatgatagtaataacaataataaagataaatgttttcttgactgggaatcagaatcaattttcttgttatctttcttcttttctgtcagagttaatattttggataaggccaaggacagaacactgtagccactagagaccattctccaggttgacattcacaaattgacaaatgttattgagcaaaaaatatttattgagcacatctatgttttagtactcttctagtgactaggaactcagtggtaaaaaagacagcaaagtccctggcctcatggagttcacattcaaaaggccagggctactgaataacacagggacataattcacacagaatttgttggttctgcaagagcaggagagagacaaattatgtgtatatgtacatatatacataatatatataatattgtatataatacaatgtcagatagtgagaagagctagaatatataatatgatgtcagataatgacatgaaccatacagaaaaagaaaacaaggtattcagtgtatttagagggcaaatgctatcttatatcatacggttaaagatctctttaaggaggtgaaactgaggtagactcctaatggaggggggccatgagctgcgcaactctctgaaggaaaagtgttctaatcagaaggacattgattcataaatgtaagcttttttggtatgaatggtcaaccaggtatttgttctcttaaaagcactgtcttatccatcagatctccaagaatagtaagaggctttgtaaatatgcttaccctaactagtctaaaccacagatggatctgagcttgtctggggattctggggaggcacagggtttgtattcccttgcccatgtgacggcctttctctctctggtgtttctccttgagcaagtgtgcaacttcatggaacataaagtaaaggaggggacccatcacccagccagatcgaatgaatcaacccttgtggcccttggggtgatgggagccccatcaaggttgctctcccaccacttactgtacacatgacatcctcactgtcaccagtccttaaagctacacacacaggaaggcatgtagaatctgttacttttctttagtgaatacatcctggttcctcgtgatcaccacttcctttttaagggctgacacaccatctagtcataccctgtttcaaaatcaagcgtgcagatctgtaggtcacagaatacactttcctccacctcattttgaaaaattagaatactaatttcctagctctacacgtctctagtacatgtctctaataccttgccccagcaccttttcaactctctacgaccctgtaaagattactgacagtgactcttagatttcatctgcaaaggctcttcatactccaggacgtaatttgtttaggcctggagacaaaaactcatttaaaacaacaagatggtctcctgctatcaccttacctatctcatacttcagttccttctaaactacatttattcaactctcctgggtttaaagatcattgtccctgataaagaaggtggaaatacaacaggagtggagatatatgactttctctttgttatttgttaatgttatatcttctgccccaagcagtgagtctgtgatttttaggtttatctttttactttgattgtagctgataagagggatgtgtgtttgtgtgtgtgtgcatgcgtatgtttctgagtttgcggatgaaggcttaagcatatttcacttcaacttactgagggatgaattctcccatcttgttgattcagttcaatacatattttcccttgcttcagtttgtggctttacatgaaggctctataaccacaccatccatggtcaaatcctggcggttcacttcctatagcatgggcaagttagttcacttccatgaacctgagttggccttatctataaaatggaggtaataatacttaaggacttgaggccaggcacgattgctcacacctgtaatcccagcactctgggaggctgaggcaggtggatcacctgaggtcagtagctcaaggccagcctggccaacatggcgaaatgcggtctgtagtaaaaatacaaaaattagccaagtttggtgccgtgcgcctgtagtcccagctagtcaggaggctgagacataagaatcatttgaacccgggaggcagaggttgcagtgagccgagatcgtgccactgcactctagcccggatgacaaaaggagactctgactccaaaaaaaaaaaaaaaaaaaaaaaatttaaaagtaaatgattgaatgtacataaagggcttagaagagtgtctggcacatagtaagtgctaatcaccaccaccatcatcattttttaatgtattcctatcatctttcatatgtatatttcagaggtcttcctggtcagccacagtttgtcttatggttaggacacacttaatccaattgtttgtatattctatctctgtgtatttaggcccaaacagtgagcattgatgtaaatgatgatgtgaggctctcaaagagcataaatcatcaaagaaatatgaaattgcatttaatgtactcatggcgggagcaaagtgaatggatgcattttacaaaggctctcagccaagtctggtttgaaacagaacagagactttacaatattcttgctctaactaatagaagccataaatagatctgagcttgtctggggggctctggaaggcatagatgaaagaattgtcttcttaatcagagaacccaaataagcaacatacccattttcaagcgttctggcttagttcgagtgcttaaggaaaaacttacctttgtcccacataaggccaaacaaatctataaaacctcatgggaatcctaaaattttgtttcatatctgtattacaaggtaaatttgaatcacttagggaatcctcagcttatcgacctttggaccatatgatagctgttggtgggacatttgatagaatttaattggttgctgtatggagtgcctgtgtacttacgttttcgtagtgaattgcctttggtgtaacagccatcgtcacattcctggccttctttgtttgtttgtttgtttttggtgttgtttgtttgtttgagactgagttttcctctgtcgcccaggctggagtgcagtggcacaatctcagctcactgcaacctctgcctcctgggttcaagccattctcctgcctcagcttctcgagtagctgggactacaggcacacaccagctgcgaatacaggcacacaccagctgggaatacaggcatgcgccaccatgcctggctaattttgtatttttagtagagatcgggtttcaccatgttggccaggcttgtcttgaactcctgacctcaggtgatctgcccaccttggcttcccaaagtgttgggattacagacatgagccatggtgcccgaccctcctggcctttgattgaagaaggaagtaaatctgcttaactgtctttcttggacctctcctatttccaggacactgacatatgtcagaaacttacagaagcagccacagcctgtgtagggagggccctagagtactggagggatgccttggactggtgggtaaatgtgactaattaaggagtattagcaagtccatttgttctcaattctccagcgaaattctcttagtcttatcagttataataataaagctgatattttgatctctatgtgtctgtcttctgtgtcttgtttctcgataggttcttaacttgagaagggaagagagagctattatttattgatctgctcgtacctcaaatggtgcaaacaagaagagtgaaggtaagcgatagtcattagctcctttctttacatgtaaccaagatgtgaaccaagacagtctggaccagttgaacaatttatccctatgagtcaatcaaaatcaaacatcactgaggccatgctctggagaggaaaatatggatttttagtgtcatagatattaaccatcaatcagctattggttatttggaaattgttggtgtctttgtccagactttgctgcctattttgcaatgtaagtagttcatgcttgttctagttttaccattcactccaatttatgggttgtgtataataacattctgctgatccttggtttccaacatgctcaggttaaccataatgattccaacttctgtttcatgtcacttcttcgtgtgtttacccaaaacacacagagttctattggaaagaaagtaaagcaaagtgtaaaatcatgagaggagttcattgcaccatgctggactaatgtttggccaaatttatgtcttgggggttgatttggaaacaatgctttcaattcccttttaccatatacgtcagaagaatttcctgttagataatatgatgttttgacttggtttcaatatgttctagtacaaatacccagggacaaattcttcagctgaatacatctgagagatgaattgtttaattgatctgacagtctttaggcaacctgtgaaaaaaggatctgattgacttccctctgggaaaacctgccctttttccacctttcatcatagttaagcaaacagacagacaaacaaacaaaacataaatctaggaagctgtgatgaaaaaggagctgctggcagcatgcaggcagaggcaaaagctaaacagagctgattggaaaatgactttctttctgtggatagagtgtgaggcttttttattacttggaagatggaggaatctcattggcttggggaaaagagaaagtttgagcaggatcaagagcagaggtcatatagatggaaagaaacgaaggtaggaaatgtctaaagttttgtctgtgcaacaaccatccagtagctagagacatcctttgtctcctcttaaggagtataaaccaggcttaaatcctttttaagccagagagaactagagtagactggagggtggaaagataaacgatggcctggatgtacaggagatggcatatcgatgcaaatgacccaaaaaatagggccagatttaataactagttaatgagcataattcaaactaattgaccagaagagaagaccctggatgcactaggcaggaccttccaagggtagaaggaaatgagcagaggagacattagttctcaagatgaagaaccagagagaactctggtggtgagccacagagttaatgccaggaaagcctgaagatagtattctttgggatgcagattagggattgttttttccaggggccagatatcagagttgaatctaaatcaaaaatgaatgaaacatgtattgatcaattgctttgtgcccatcactgtgctgggtattgaagatagagtgggggcggggggcaagacaacctaactcccgccctcctggggcttacaattcagaaggaggtggagcaaattaaaaagttgtaggccaggtgcagtggctcatgcttgtaatgttagtgccttaggaggctgaggaaggaggatcactcgaggccaggaatttgagaccagcctgggcaacagagcaagacattgtctgtacaaaaaataaatacataacataaaaaattagctgggtatgatagcgagggcctgtagtcccagcaacctgggaggctgaggccagaagattgcttaagcccagggatttgaggctgcagtgagctatgattacatcactgaactccagcctgggcaacagagtgagagaccatctctaagattaatagtaataataataatagtaataataataataataatagtaataataataataaataaaaagttgcaagtgctaagtggtacagggtatcatggcaacacataggccatacctgacccagtagctgggagtgaggttaggggaatatttctggaggaaattacgtcgaagctgagagctgaaggacaagttggagttaggcaatcaaggaacaaggaagaacattccaggccaagtgagcaggatgtgggaaagcctgggggataggtgagaaagagcttcagagttaaggattcagaaatctgaaagtaggttaacactacactccaggcactttttgcaggtagtgagtttgcatgagtttgagtctgtagaaaaaagttcaagtcttgacaaagtcaccaggtgaacatttcttgatgtttgttccttgggatgcaaggggtggggcaatacaatggcattgagggggtccccaggactttggtggagaacccagcaagcctgtcggcagggaggtcagcgggacggtggagcaggttttgtgtgattctctggatgcttgggccgtggccagtagacaacatgctgccaagttcagaagaaaagaatcatactgcataggaaagtgaatcttgcacatggccagaaaaaggaaagacaatttagttttatatgttacactttaataatagtcgtttggaacttcataatgaaatttgtgaaaaaagttcatttccagaagaataatctctaactggtatgcaatgccgcagtaggatttgtccaggttttaattttagtttgaataaataatgtaagatactagcctgggtgagataaaagaaaatctctctgctttcatctctccatgatggaaataataactactttatttcaaaacaagtttccaattagtttctgtgaaatattattatccccctttcccagatactgtagctcattttgaaacttaattttgataatatataaacatttctgaaacttaccctacaggaatgacagttatatttgaagggaaggacgctgctgggctgtaactgtattatttgggatggttctaaataatagtaaaaataataaaagggaatcagtcaaagtgcaatctcatttcatggctatttatgacctagcaaggacttatcttcaccaagagcacagatgaagcaaggccactttctccaaagttattcagtggaattttttcctttcagcactagttatgggctttacttaagaatgtatatcatcttcttcctatttacagagatggtattgtttaaatatttaatgaattaagcgtaatagaacacctactgtgtgccagacgcggcctggggcttgtgtgctgggattggcacggtcaattaggtagatgtgacctctgcctttgggggacttataatctagaggagaggggcaggagttaaaaattttctctgtctctgtctctctttctcccctcctctccccacacacacagtgatagaaataagaggtctatggtggcttgagaacacataataggaagagtcagactgatcagactgattacactggacagggaaaggctttgatatgattcggttgaggtaaggtatagattagttatgatacaagctaagctctgtcacaaagatgctacattgtcatggcttcaataagatgtaaatttctttctcttttatatgacagaggtgagcagttcagggttggtaggcagctctgccatcttcaacatctggcttccaatcctacctctgtggatatcattttgagccagaaggaggggagaaagaaatggctttcaagaggtgacttggcagctgtacacatcattgtttcttggccagaatttagtcacatgaccacacctagctacaaagtaggccagaagatgttgttagtggtgatagctaggtgcgtgggagttctatttaaaaggaagataagaatggatgctggtgggcagaggggacagtctttggcacagaaatgaaggatgagtaagagttaattaggctgaagtgaagggagacagaggggtagcacatggaaaggctgcatcactggaggaagtgtggtgaccttcgctgaaagtaggtcacgggcctgggtcatagaggtgggcagattcaaggtgagctgggcatgagccagattacgcttagcttatggctcagggcaaaacgttggtcttcattctagagccagtgaagccattagggttgaaaatggaaggaaggggacccaagaaaattctctctttgaagagatcacctattacagtgtggagaatggatcagagggcacagtagtcatacaccacatcaggcaccatgctaggtgctgggaaatggcagctgagcaggatagacccaatttctgacctcccagagtttacattctgtgggagggagggagaaagctaaggaagatctaggagtcacaagggataactttcctacgacagagccaggcagggactgtcagtgacattttgactgtaagttgggagaggccctggttctgctttaactgcagcttctctctccataaaatggaggaagcctccaacaatgggttcattcaaaggggaggtattttctaccagcttcttcttttttttttttctttttttgagacagaatctcactccgtcgtccaggctggagtacagtggcataatctccgctcactgcaacttctgccttccaggttcaagcgattcttctgccccagcctctggagtagttgggattacaggcgtgctccaccacacctggctcatttttgtatatttttggagagacgaggtttcaccatgttggccaggctgttctcaaactcctggcatcaagtgattctatcaccttggcctccgaaagtgctgggactgcaggcgtgaaccactgcacctggcccagcttatttttcttaattgaagtaaaattcacataacataaaattaaccattaaccactttaaagtgtacaattcagtggcattaagtgcattcatatattgtataaccaccatctctatctagttccgagacatttcgtcacccagaaaggaaagctcgtacccattatgctccatcatactcctactccctgtcactcaaacccctggaaactcattagcctgctttctatgtccatgaacttacatattctggagctttcatttaaatggaattatgcaatatgtaacccttagtgacttgcttctttcacgcagcatgaggtttttgtggttcatctatgttatagcatgtatcggtattttatccttttttatggctgaacaatattccattgtatagatagaccatattttgtttatccattcattcattgatggacatttgtactgtttctgccttttggctgttgtgaatagtgctgttgtaaacctttgagtccacttgcttatttttttcccaaagtaggttttttcatcctatgtgtaaaaaaccaacaggagaggaaacaaaagatgaattgaattcttctatcctcagttgtgtaccgtcacccccatcaccctgacccaagtgcatctacgggctccagggtcctgccctactccactcaggctgtcacagttctctcctgttgcctgccccacttctattttccatgccagctcttctgttctcccagtgggatttccgtggtctctgaaggaaactccacacctctgcttttgcttcctgtcctctcactcctctacccatcacccacacctggaaaccccacccccattcctggttttccagactccgtcattcttcatgattgcctttcttcaaagtcagcacagtgtcatcattcgaggaaggtgggaacagcatgaggaagtgaggagaaggctgttgatgtgtgaggaggtcagctggttcattctttcctgttcatccattcactcattgttttattcatttttccaacgaagatttattgagcactcactctagataagaaactagtgctaaagcttcagacatggatgcatggcctggctcttggagttcacaagtgagtcagatgtctaaacaaaaaagccacaagacaatacagacttttaatagggatacaaacaaggtattgttggagcttggacaaagcaggtgggcaaggggtatttgagaaattacaagggcactttgtgggagaggtttttctatgcaagttttcccctagatcctaccgaaataaagccatacctttaccttgtattttaagccaggacatgaccattatctgtgaatcattccagatggataaactgaggcacagaatactcaggctcaaacctttagtaataaagtggtgatttgactgaaaagttgattccctgatgtgttcttcatttcccagcccccataagctcacttttctgtaattgcagggtgcaattctctgtttttcttccctcagtgcaaaaaggcagactggtgatgctatttttcacatgaagaaaacaaggcagggggagtttactcaaggccacttatcacttttatggaggagccagaatcacagctcctaccctttgagtttccagctcgttgcctagctaccaaacctccctacctcttccaccaagcagcagctgagcaggcacttaataataataattgatggtgttggctaacagggaaagttcagagtggttctggggagtttgttttcacataccaataaattttattcttctatggtcaataacctatattaatttgctttagatagcacccctgtcttacttcacagtgaagctttcttagctacattgatgatttctcttattttctttatctcaactattctttcttggggactacagttgctgtttacagttattacacattttaaaaaggggaaattgatatagtgtctgttctagggcttccaagacaagagcctcattataacaattttaagaaatagaatgaaattcagtgaaagttaaatacagttctccagaaagtaacacttctgcttcttaaagtattagattcatttattgattgattaattaagttaaaaatatttgcacaactagatgttccagacactaacaggagtaaaaagataaatctgtttatcctttcaactatgatataccatgttaatgctggggatgctgtggttttcctcatgttgcgcacagtccagcagcagttggatgacctcacatgatcacacaagtgggcaattgcagccttcatatgcgtctcacagaagaagcacacagagctgtgagtgcccctgattggtggatttgacacagtcagggaagtcttcccagaggaaatgttgctcaagttgagttctgatgaatgagcagggggaaccagaagaagagggaaggaaaaagtattccaggcagaggaaacaccttcaaagacctggtggtaggtgagaacatgtggagtccaggagctataagactagcatggtttgaatgaagttagaggtcgaggggaagctggagagataggtagaggccagatcatgcacagcatcaggtacctgtgctacgccgcatcactcccactctaattccagccaaggctacggtgaacagtgccacaccagctcccatcagctttatgctgaccttgtcctggagcttctctggttccaggcctaggcctttgcagacctggcagccatatgtgagcaacccacacataccagggtgttagtgtccatggagcaactctcaaccattggtggatgaaaggcagtgggtgaatgcttctaccttttgtctctggtggacagttctgagacacattccccatggtacctaagaaattcctcacagaattggtcatagttgctcacactggtaatcaacttattctttctttcatttcctccttctctgttctacccagtttccatgatgcatgaactcctgctccctggtgtcatgtcccaaataaaactatgtgcaggcacacttttgtgacctgctgttttggggtaagccagatagagatacaatgttaaagagttttgtctttgtcttaagagcaatggaaaataattgcatgtttggacaggtgaagttccttccttccttccttccttccttccttccttccttccttccttccttccttccttcctcccttcctcccttcctccctccctcccttccttcattccttccttccttctgtctttctttctttttctttttttttttgaagatttctttttttttaaattacactttaagtgctaggatacatgtgcacaatgtgcaagtttgttacctatgtatatatgtgccatgttggtgtgctacacccattaactcgtcatttacattaggtatatctcctaatgctttccctcccccatccccccaccccacaacaggccctggtgtgtgatgttccccttcctgtgtccaagtgttcttgttgttcagttctcacctatgagtgagaacatgcggtgtttggttttttgttcttgcgatagtttgctgagaataatggtttccagcttcatccatgtccctacaaaggacatgaactcatccttttttatggctgcatagtattctgtggtgtatatgtgccacatttcttaatccagtctatcactgatggacatttggattggttccaagtctttgctgttgtgtatagtgccgcaataaaaatacatgtgcatgtgcctttatagcagcatgatttataatcctttgtgtatatacccagcaatgggatggctggatcaaatggtatttctagttctagaaccctgaggaattgccacactgtcttccacaatggatgaactagtttacagtcccaccaacagtgtaaaagtgttcctatttccccacatcctctccagcacctgttgtttcctgactgtttaatgattgccattctaactggtgtgagatggtatctcattgtggttttgatttgcatttctctgatggccagtgttgatgaacattttttcatgtgtcttcttttggctgcataaatgtcttcttttgagaagtgtctgttcatatcctttgcccactttttgatggggttatttgttttcttcttgtaaatttgtttgagttctttgtagattctagatattagccctttgtcagatgagtagattgcaaacattttctcccaatctgtaggtcacctgttcactctgatggtagtttcttttgctgtgcagaagctctttagtttaattagattccatttgtcaattttggcttttgttgccattgcttttggtgttttagacatgaagtccttgcccatgcctatgtcttgaatggtaatgcctaggttttcttctagggtttttatggttttaggtctaacatgtaagtctttaatccgtcttgaattaatttttgtataaggtgtaaggaagggatccagtttcagctttctacatatggctagccagttttcccagcaccatttatcaaatagggaatcctttccccatttcttgtttttctcaggtttgtcaaagatcagatggttgtagatgtgtggtattatttctgagggctctgttctgttccattgatctatatctctgttttggtaccagtaccatgttgttttggttactgtagccttgtagtatagtttgaagtcaggtagcgtgatgcctccagctttgttcttttggcttaggattgtcttggcaatgcaggctcttttttagttccatatgaacttcaaagtagttttttccaattctgtgaagaaagtcattggtagcttgatggggatggcattgaatctgtaaattaccttgggcagtatggccattttcacgatattgattcttcctatccatgagcatggaatgttcttccatttgtttgtgtcctcttttatttccttgagcagtggtttgtagttctccttgaagaggtccttcacatcccttgtcagttggattcctaggtattttattgtctttgaagcaattgtgaatgggagttcactcatgatttggctctctgtctgttattgatgtataagaatgcttgtgatttttgcacattgattttgtatcctgagactttgctgaagttgcttatcagcttaaggagattttgggctgagacaatggggttctctaaatatacaatcatgtcatgtgcaaacagggacaatttgacttcctcttttcctaattgaataccctttatttctttctcctgcctgattgctctggccagaacttccaacactatgttgaataggagtggtgagagagggcatccctgtcttgtgccagttttcaaagggaatgcttccagtttttgcccattcagtatggtattggctgtgggtttctcataaatagctcttattattttgaaatacgtcccatcaatacctaatttattgagagtttttagcatgaagggccattgaattttgtcaaaggtctttcctgtatctattgagatgaccatgtggtttttgtcgttggttctgtttatatgctggattatgtttattgatttgtgtatgttgaaccagccttgcatcccatggatgaagcccacttgatcatggttaagtggctttttgatgtgctgctggattcagtttgccagtattttattgaggatttttgcattgatgttcatcagggatattggtctaaaattctctttttttgttgtgtctctgttaggctttggtatcaagataatggtggcctcataaaatgagttagggaggattccctctttttctattgattggaatagtttcagaaggaactgtaccagctcctccgtgtacctctggcagaattaggctgtgaatccatctggtcctggagttttttggttggtaggctattaattattgcctcaatttcagagcctgttattggtcttttcagggattcaacttcttcctgttttagtcttgggaggtgtccaggaatttatccatttcttctagattttctagtttatttgcgtagagatgtttacagtattctctgatggtagtttgtatttccgtgggatcagagatgatttcccctttatcattttttattgcgtctatttgattcttctctcttttcttctttattagtcttgctaatggcctatcaattttgttgatcctttcaaaaaaccagctcctggattcattgattttttgaagggttttttgtgtctctatctccttccgttcttctctgatcttagttatttcttgccttctgctggttcttgaatgtgtttgctcttgcttctctagttcttttaattgtgatgttagggtgtcaattttagatctttcctgctttctcttgtgggcatttaatgctataaatttccctctacatactgctttaaatgtgtcccagagattctggtatgttgtgtcttcattctcattagtttcaaagaacatctttatttctgccttcattttgttatgtacccagtagtcattcaggagcaggttgttcagtttccatgtagctgagcagttcggagtgagtttctcaatcctgagttctagtttgattgcactgtggtctgagagaaaattggttataatttctgttgttttacatttgctgaggagtgctttacttccaactatgtggtcagttttggaataagtgtgatgtggtgctgagaagaatgtatattctgttgatatggggtggagagttctgtagatgtctattaggtctgcttggtgcagagctgagttcaataccttggtatccttgttaactttctgtctcgttgatctgtctaatgttgacagtggggtgttaaagtctccgattattattgtgtgggagtctacgtctttttgtagatctctaaggacttgctttatgaatcttggtgctcctgtattgggtgcatatatatttaggatagttagctcttcttcttgaattgatctctttaccattatgtaatggccttgtctcttttgatctttgttgatttaaagtctgttttatcagagactagaattgcaacccctgccttttttcgttttccatttgcttggtagatcttcctccatccctttatttggagcctatatgtgtctctgcatatgaaatgggtctcctgaatacagcacactgatgaatcttgactctttaaccaatttgctagtctgtgtctcttaatgggagcatttagcccatttacatgtaaggttaatattgttatgtgtgaatttcatcctgtcattatgatgttagctggttattttgctcgttacttgatcagtttcttcctagctttgatggtctttacaatttgtcatgtttttgcagtggctggtactggttgttcctttccgtgtttagcgcttccttcaggagctcttgtagggcaggcctcgtggtgacaaaatctgtcagcatttgcttgtctgtaaaggattttatttctccttcacttatgaagcttagtttggctggatatgaaattctgggttgaaaattctttgctttaagaatgttgaatattggcccccactctcttctggcttgtagagtttctgctgagagatcagctgttagtctgatgggtttccctttgtgggtaacccgacctttctctctggctgcgcttaacagtttttccttcatttcaactttggtgaatctgacaattatgtgtcttggagttgctcttctcgaggagaatctttttggtgttctctgtatttcctgaatttgaacgttggcctgccttgctagattggggaagttctcctggataatatcctgcagagtgtttcccaacttggttccattctccccgtcactttcaggtacaccaatcagacatagatttggtcttttcacatagtcccatatttcttggaggctttgctcgtttctttttacccttttttctctaaacttctcttcttgcttcatttcattcatttgatcttcaatcactgataccgtttcttccagttgatcgaattggctactgaagcttgtgcatttgtcacgtagttctcatgccatggttttcagtgccatcaggtcatttaagacttttctacactgtttattctagttagccattcgtctaatcttttttcaaggtttttagcttctttgcattgggttcgaacttcctcctttagcttggagatgtttgattgtctgaagccttcttctctcaactcgtcaaagttattctccgtccagctttgttccgttgctggtgaggagctgcgttcctttggaggggggaggtgctgtgatttttagaattttcagcttttctgctctgtttttttccccatctttgtggttttatctacctttggtctttgatgatggtgacgtacagatggggttttggtgtggatgtcctttctgtttgttagttttccttctaacagtcaggaccctcagctgcaggtctgttggaatttgctggaggtccaccccagaccctgtttgcctgggtattagcagcagaagctgcagaacagcgaatattgctgaacagcacatgttgctgcctgatcgttcccctggaagctttgtctcagaggggtacccagccatgtgaggtgtcagtctgcccctactggggggtgcctcccagttaggctactcgggggtcagggacccacttgaggaggcagtctatctgttctcagatctcaaactcgatgctgggagaaccactactctcttcaaagctgtcagacagggacattttagtctgcagaggtttctgctgccttttgtttggctatgcgctgtccccagagatggagtctacagaggcaggcaggcctccttgagctgtggtgggctctacccagttcaagcttcctggctgcttggtttacctactcaagcctcagcaatggtgggtgcccctcccccagccttgctgccgccttgcagtttcatctcagacggctgtgctagcaatgagcgaggctccatgggcgtggggccctctgagccaggcgagggatataatctcctggtgtgccatttgctaagaccgttggaaaagtgtagtattagggtgggaattacctgatttcccaggtgccatctgtcaccgcttcccttggctaggaaagggaattccctgactccttgcgcttcctgggtgaggcgatgcctcaccctgctttggctcacacttggtgggctgcactcactggctgatgagccccagtgagatgaagccagtacctcagttggaaatgcagaaatcacccgtcttctgtgtcgctcactctgggagctatagactggagctgttcctatttggtcatcttggaaccctgttccttccttccttccttcccttctttccttctttccttctttcctttctttctctttctttctttctttctttctttctttctctctctctctctccttccttccttcctctctctttccttctttctttcttttttcccttcattcccttccttcctttccttccctcccttccctctctcttccccttccccttcccccttccctcttccttccttccttcctttctttctttctttctttctttctttctttctttctttctttctttccctctctctctctgtctctctctctctttctttctttcttcccttcttccttccttccttcacagagtctcactctgtcacccaggctggagtgcagtagcatgatctcagctcactgaaacctccatctcctgagttcaagccattctcatgctttagcctccagagtagctgagactacaggagtgtgcctccatgcccagctagtgtttctttttcttcatatttttagtagagagagggtttcactatgttggccaggctggtctcaaacttctcacctcaggtcatctgcccaccttggcctcccaaagtgctgggattacaagcatgagtcaccatgactggcctgaagttaatacttcagcacttcaaagagatcattttggttgtagtgtggagaattaattggaggaagacaagagtaggtgaaggtagagtaattagtaggcattagtagtcccggcaaatattaagatagttgggatggagtggggacaataaaagtggaaagaaatagacagatctgagaatatttagggcctctaatcgacaggacctggtgactgattggatatggaaggcaagggagaaggaggaatttgaaatgactcctaagtgtctgatttccttagctggatggatgatgatatagtttactgaattggagactctggaagatcaggtgtagagcagagggtatcagttaaagttctttatgatccaagtgatagaaaatctaacacaaattagcttatacagaaagggatttagttgactaaactggaaaaaatgttatattggcattaggcatggcatgtggtcaaagaatatgacaggaatcaatctctttgctctgtttcccttgggtacctttgtccacttatggaaacaagatgaccatatactctactcactccaccaagtacagagaaagggcaaggtcttctctttctagcagccccagctaaggcatcactgtgaattgcttggtttgattggattatatactcacagcccaagagtcaccctggccagagtagtgggtgagagtggaggaacctcacagagaccaggttggccaagagttggaggaataaagtccttaaaggaaattaggatactgctgctgtaagaaacagaaaaattgatgctgggaaggtgtattagtcttttctcacactgctatgaagaaatacccaagactgggtaatttataaagaaaagaggtttcattggcccatggttctgcaggctgtacagtaagcaaacaccttctgcttctggggaggcctcagtaaacttacaatcatggtggaaggtgaaggggaagtagggaagtcttacacagccagagcaggagaaagaggtgggggggaagtgccacccacttttaaacaactaggtcttgtgataactcatttactaacatgaaaacggcaccaatacagaaatctgtccccatgatccaatcaccttccacctggccccacctccaacattggggattacaattcgacatgagatttgggcagggacacagatctaaaccctatcagaaggtacccacaagttcccatgactagttccttagttgtgttttgaacatgatgtatttgaggtgcctttaagatattcaaaatatgatggacacttgggtttaatctcactggtgagttctgggctggaaatacactttgagtgtaatttgcataaaggtagtatttgaaaccgatggaatgaatgaaatcaactagggagacgaatatacagtgagaagatcaaagaaccaaggaaaaagtgtggaggaattccaatattgaattgaaattgaattctcctttacttgaattttcaggtagccagagaggtaggaagaaatccaggaggactcatttaacaaacacagtagctgcattcttggaatttattgactaataaccacacttgaaataaaaaaactgatagtaatatagacagttataacaccataagttaaggttgtgttagaggtatgaactcccagagcatcccacaggagcagagagaagaggctgactaattgttcctgggggagagaaaagcattatatgggaagtcttgaaagatgattgaaattttgccagttggagaagaaaaagctgcagatccaagttgaacttatataggagactcatgaaggatttgagtcagatctatgagaacttcaggaaataggccaggatgaatgttgactaagggggaaaagttggagttatcacataggtcacctttgtgggtggctgtttatcttagggcttgtctatgtcactccatcatttcaaaagccatcttgaggccacgcacggtggctcgcacctgtaatcccagcattttgggaggccaaggcggatggatcaccttaggtcaggagttcaagaccagcctgggtaacatggcaaaaccccgtcgctactaaaagtacataaattagccgggcatggtggcgggcatctgtaattccagctacccggaggctgaggcgggagaatcacttgtacctgggaggtggaggttacagtgagctgagatcatgccagactctgtctcaaaacaaaacaaaacaaaaacaaacaaacaaacaaaaagacatcttgaagctgacgttgtatcctggatttgtgtttatcctggattggctggttggttgaaatattgatgggcatttttggcattagaaagagtaaatttaaaaggtttctatatggtgaatattgactagttattttctgttactgccaaagtgaaaacaagaagaaatatgattgcatttcaacaaagatattttaagataaacattaagatgagttttcttttcagcgacatttattttacttgtctgcatcagccttcgaatttataggcttagccagacaatgataacagcagtcaaagatagaaaggttatacattaaacaagcagacaaacaaaaacataaataaataaagtcaataagcttattgggaatgggtgagctgaagaagtcacaattgaggcaattaccataacatttccaactagttagtatcaagtttctggaatttatgacttagggacctgattagccagagggcttgggtagaggcacacgttccaggcattcctggcaaagggtagctgtgataggcagaataatgtttcccaaagttgtccacatcctaatcctgggaagctgtgagtgcgttgggctatatgacaaagaaggattaggttgcagatggaattaaggttgcctgtcagctgaccttagagggggattttccttgtggggctaatttaatcataagtgttttttaaagtagaagagggaggcagaagagaaagtcagagtcagagaaatatttgaagatgctacgctgctggcttcaaagatggaggagggggccatgagccaaagaatgcaggcagcctctagaaggtggaaaaggcaaggaagcaggctctcccctagtgcccccagaaagggaggctcatctctgccgacacctggattttagctcagtaagacttttggacttaccttcagagtcacaagacaatacacttatgttgttttaagccactaagtttgtggtaacacggtacagcagcaacaggaaactaaacagtggccaagatggtctaacaaatgatagactcatgcagtaggttagtttatggtatagacagaagctaggtggtaataggggaggccagggactcaagatgttatcattacctctattttgttaattaaaaacgaaacgttttattttggagtaaatttagacttttagaaaagttgcaaaaatagtacaaagaattcatatgtaccctttgcataggtggaaatagggaagttttttattaacacatataatgtaataataatctgtgaggctcttatttcctttttttagtttattacattgactgggatgcatccagtatgatacatccagtatgatgctgaacaggactgataagagaggacatccttttcttgagcttaatgggacagcattcagtctttcatgactacatatgatatttcttctttttttttaatgttcacattgtgaattgtattgaatgactttcaaatgttgaatcagtatccctgggataaatcccacttgattgtgattgatatgtttggctgtgtctctacccaaatctcatcttgaattgtagttcccataatccctatgtgtcatttggagggacccggtgggaggtaattaaatcatgggggttgttacccccataccgctgttcttgtgatagtgagtgagttctcacgagatctgatggttttttgaggggctttcccccctccttcactctgcacttcttgctgccaccatgtgaagaaggacatgattgcttccacttctgctatgattttaagtttcctgaggccttctcaaccatgcagaaccatgagtcaattaaacttctttcctttataaattacccaggcttgagtatatcttcattagcagcctgagaagggactaataccgtgatatatgatcctttttatatagtgctagatttgatttgctagtattatgttgactattctagctgaccgcttttccccagtgtccatccagttccatctaccccaggtaagctagtagtcacatctccgctctccttgaagatatctgtctgaccttgtattttggaccaactgattgccttgagacctcagttctccaatgtgtttgaaaaaagtaatgaatttgcaattgtcttgtcttgttgttttgttgctgttctacgggagagggcaaagctctgtccaagtatttatatccgtaagtggaaactagaggctctgcaattgttttttccaccattgtttgtctgagataagatccaaattagatttatacaacctaacggttgatatgtcccttaagtctcttttgatctatagtttctccctgtttttctctctttttgtccctcaccttcttttctctgtattgttgttggagataccagcattttctatcttaaagtttgccacagtctgaattttactgactgtgtccctgtggtatggtttaatatggttctctgtcccctgtgtttcctgtaaattggtagttagatcttgagactttatcagaatcaggttcattttttgataatttgtgatatagatatttctttaagtgtgtgtgatgttatcagccatcgatgttcaatgcctagctctattaattcattaggatgtgttcattcgctgtctttgatggatgaagaaaatgaggctcagagaggttgaattcctttcctaaaattcctttctttttttttttggagatagaatctcgctttgttgcccaggctggagtgcactggcacgatctcggctccctgcaacctctgcctcccgggttcaagtgattctcctccctcagccttctgagtatctgagattacaggcatgcaccaccacacccagcttttttttttttttttggtatttttagtggagacgaggtgtcatttttttggccaggctggcctcgaattcctggccgcaagtgatctgcccatctcggcctcccaaagtgctgggattgaaggtgtgagccaccgtacccagcctgaattactttcctaagacaatacggacagtaaggttgtacccaggcctggaatctgtgtcttataaacgcaagctctatatccatttataagcctattgactttccagacttagcattattaagtcacagcaagatcaatgtttcatcccgaaggacatgggacactctcatctcttttaggaagagatgaatctctatgaattcagttttgcttggagtgattataccataccataccataccataccataccataccataccataccataccataccaagtgattattcaaaatattttcccctcaagttctgcattacatttgttcttatggatacaattaaagaattatccattgctaattgcagtgcctggagtggtatccaaactcaactcagaatcctgagcacatttgggtttctgcttgcctcttcagttcaacagaagaaaaaacaacaaaacaaacagatgtagaataaatactacaaagcaatttgttttttttatattgcattcaagacttgctactaaaatttctcttctgagagaagaagagacagggagagagagagagtgagagagagagaatgttgcaactgttttttatctactacctaaatttttcatgaatttgtatctaagatgacatagtatctctcttgggggcaagaaatttcataaatcattggttagagttagtgtaaacaattcaggagaaatgcattttcaactctaaaaaaaataaatttgttatgttcaaataggccaaggacagacatctctcttgacctgaccttttatttttcaacacaagtggatgtacttaggttgccttcctgtatcatctgacctaagagtgtgacattcctgagcttattttccaaaagaggtcaagaacttcccaccctgtgaatattttcttggaagcttggagtttatgaaatcagtaatataaagattattattgaaacaccttctaatctatttcaaacacaacttatacagtgagggaggatgaatatggctttaccttttaaccacaaagctctgggattcccaagcagagaaaaggcccggcttctctacttcctcctaggaagattcaggaactcttaggtgagattggaactttttgacctgaatggaactttttggttctgctggacactaggagaaaatcaggcagaaatctaaaaatcctatcaaactttggaaacagtctcaaagggccaggacgaggaccagggttgacagacatagattaggaattatatttggagtattaaggtagtgtggagtctcagcaattatctggtccaacacattttgaatgctgacttatacaaagttgcaaaattgtcaatggccaagcagagattggagtctgttctgctaagctgttccttgaacttctctccccctggcatctgaattcagaagaactgggcatggtttctggctctaaagttcactgtattggtgaccttgggtaaatcacactgactgtcactggacctcatttcccccatctgaagaatgcagatgattgcgattcaggttgtagtggattaaatgggggtaatgtgtgtggaagccttcataaactagaaagcacatggaaaagttattagagctatgcaattggactgactctggttagatccactgacattccccaggaaatttgacactagatcaagacttcctctcttcccaaaaaccttgggtgtgaatccaaagcccattaatatcttgggaataaggagcagcaggttggtcagttcagtaagatcatcctaacaggctcatgtatagtctggaaggagcctgactcttgggagtcaccagtaggactgtgtgggtgtctttcagtattctctttctacttctgctgcagctgcaaaaacatacagttcataaatttctctaatgcctataggagccctcactagggatctttggaaagagtaatcttcacatttaaaagtattttctcattatggataatgggatgatgaggtgaaaaatgatcttagctacttatgattctaaaaagccttcagatggaataacctatggagaattagacataatggcagcaaagaaataactcacttactacaaggtccacttacttatttaatcactgttactgtcatacaaatatgtattccgtacaaagtgatgaaaagttagtagtggcataaaatgcagttgtggaaggacaacttagcaaatgcagacataaacacacatatatatttacatgtgtatatcatttttgttttggaataagttttgatttacatttaagttgcaaagatagtgcagagagttcctgtgtacccttctcccaggttgtcctaatgttaacatgttacataaccaaaagacaaagttatctgatgacctaaagaaaaaaaaattaagaacattgaagaccaattaacaaagtttgtgctgaaattaaggtcattctaagtggagagattgggataaatattttcaacatatgtaacagaaaacgtattaatacccaataatgaaacttctatgaattagttgctgtaaatggcaaacacctaaataaaaatgtgcagaaaaagaaagattgggtaatttgcaaaggaatgaaaaaggaatgtccaaaatatttaaggaaataaggtcatctgaagttgtaattagtaacataaaaaataagattatcattccttagaatgtcaaaaatcaaaaagcttgataataccagatcttcacaacaatgcagtgaaatacacattctcatatgttgttggtggaagcatgagttgttcaagcctgttgggaaggcacttcgttaatataaatcagattttaaggttcacatagtttttgacttaacaatccatttctaggagattttttaaccaaaaaccctcaagcacatgttttataaaaatctatgtacaaggaagttcgtgttagcattagttataaaagtaaaaaactggaggcaacatgcacgtcaataactgagggtgtagtgaatacattatcgtatacattttctgtgcaaagctacatagtcattataaagaatgaggtatagctgtgtgttcagatgtgggatgatctctgagatgtgtcactatgaagtggagaaagcaagtcacagaactgataggagagccggcttccttttgtgtttaaaaaaaagaaagtgtgtgttcatatatgtaaagatccatgtataaatccatgcagcaatggagagtacccgccaaagaacagggaaagggcccactcatgttttaaattgtgtatttttggatgtttgaatcttttacaatctgaatattatctatatgctatttatacaattcaaatttaaataagaaaaagaataagaattttctctgttattgtccttttactcttaagaatataaaacaatacttatgtatttgcaatgaaaactggggatttagagagagtgaagtcgcccgagtatgtctcctgacaaaaggcatctctcgatactggctcacatgtccagataggtcaagctaccttttggaagcccagttctcttcagcaatttcttccattttggtgggtactttctaacgcgcttcccaaccctgggccatagctaagggcccttctgtttccccgcacaggctggctgttggcagcctttgctcaaaggcagactgacgtcctaatcagagtgctttgccggtagcactggcatttcagaaacactgacaaccgcggcggaagcagcagataaacagcatatcacccgctagagtgggccttgctgtttctcagattaaatggaaacatatgcccaattgtgaattttaaacagcgttatcagactgtttgacagctcatccagtaatataataaggttccactgagaaggtggaagctgtaattcaaatttcagaatttccttttatatatcggtagatgagagggttgtgggtatggtttccatgtacctggggctggtgtgtgtatgcacgcattcagatgcttacatatgtgcgtatgtgaccgtcctaatttaaaatattttatgctgttttctttgtcaaccaccaacatattccccaacgataaaattcttatgtctaagccacatttccaaggggtcagagggtgggtgggtatacaggaggggggatggaaaacaaattctggctggggttatgctgtttaacgatttataatttctattctaactgtgtaccatccattcgcacaataagtatattttctttgttaagaaaaactcagaaagaagtacagcagattaccaaatatagaaagcaacttaagtattcatctttcataaaacttgttttggtaaatggtttcattctgagaatcttttatattttaattttaaaacaattgaaaataattgatgtgtttatggccttcgtttgtattcttgaaaggaatatctcggatcatcaaaatgttgccaacttctacatcatgtgccagatgtgtggggctgagacaactgtaaagaagtagtgtgtggtgtgtgaggtgtatgaatgtggtttgtgtgtgtgatgtgtgtgtgtggtgtgtgtgatgtggtgtgtggggtgtgtggcgtggtgtgtgtgctgtgtgtatggtgtggtgtgtgtgctgtgtgattcgtggtgtgtgtgctgtggttcatagtgtttgtgtgtgggtatgtgattgtgtgtggtgtgtgaatgtgtggtgtgtgtgtacgatgtgtgttgtgtggtgtgtgtgtgctgtggtgtgtggtgtgtgtgtggtgtggtgtgtgtggtgtgtgtatgatgtgtgtgtgtgctgtgcatggtgtgtgtgtggtgtgtggcatatgcgtatgatgtgtgtggtgtgagtgtatgatgtgtatgtggtgtgtggggtgtgtgtggcgtgtgcatggtgtgtgtggtgtgtgagtgtgcggtgtggcatgtgtggtttgtgtatgtggtgtggggtgtgtgtggtgtgtgtgtgatgtgtgtgtgtatgatgtgtgtgtgtgtgttgtatggtgtgtgtatgatgtgtgtgtggtatggtgtgtgtgcagtgtgtgtggtatgtgtgtgtggtgtgtgtggtgtgtggtgtgtatatgatgtatgtgtgtgtgtatggtgtgagtgtgtgacataagcatggcaaagggcaggattacaccgaaagccaaagcaagaaccttctttttttccatctttcctttcttttcttttctttccttttcccctttcttttctcttctgattacttcagtcttctcttcctcattttcccttttattctatacttccctttaaaaatgtttcataactttaaaaaaattgacatatcatagttcgtacttggggggtacacgtgatgttttgatacctatatacaatgtgtagtgatcaaatcatggcaattgggttacctatcacctcaaacatttttctttcccctgtgttgggaacgttacaattctttctcttctagctacttttaaatctacaataaattattgttaactataatttccctactgaactatcaaatactaaaacttattcttccatgtaactgtatttttgtacccattaaccaacttctctttcccccttttcctccttccctccccagcctctggtaagcactattctactctctaccgccatgagatctatttttttttagctaccacataggcatgagaacatgtgatatttgtttttgtgtgcctggcttatttcacttaacataatgacctccagttccatccatgtttctgcaaatgacagggcttcactctttttattgctgaataatattccattgtgtatacaaactacatattctttatccattgatgcacacttaggtagagtccgtatcttgactgttgtgaatagtgctctaataaacatgggagtgcagtatatcttcaatataatgatttcctttcttttggatatatacccagcggcggtatttttggatcatatggcagttctatttttagttttttgaggatctccataatatttttcgtatggctgtactactttgcatttctacaacagtatacaagaattcccctttctctgcattctttccaggatttgttttattttattttatttattttatttttgagatggagtctcgttctgtcacccaggctggagtgcaatggcatggtcttggctcactgcaacctccacctcctgggttcaagcgattctcatgcctcagcctcctgagtagctgggattacaggtgtgtgccatcatgcccagctaatttttgtatttttactagagatagggtttcgccatattgggcaggctggtgtggaactcctgacctcaagtgatcagcctgcctcagcctccccaagtgctgggattacaggtgtgagccactgtgccctccgggatttattattttgtatcttcttgataataatcaatctaactggagtgagatgatatctcattgtggttttgatttgcatttccctgaagattagtgatgttgagtttttttttttttttgcttaactttcggccatttgtatattttcttttgagaactggctgttcaggttttttgcccattaaaaaaaactaggaatggggtcaactggggtgttgcccaggccagcttcaaactcctgggctcaatcctcttgcctcagccacctgagtagttgggactataggcatgtgcctctgtgcctgtgtccgttttaagatcagattatttgctgttgtttgttttattgctcttgagttgtttgagttccttatatattctggttgttaattccttatcggatggtgctatagttcggatatctgaccttccaaaccttctattgaaatttgatccccaacaatggaggtggggcctaatgggaggtgtttgggtcatgggggcagatccctcatgaatgacttggtgccatccttgtggtaatgagcgagttatccctctattagttccaaagagctgattgtttagagtctggtggtacctttcacccctctctcttccctgctgtcacaccgtgtggtctgtgtacacacctgctctccttcaccttccaccatgagtggaagcagcctgaagccctcaccagaagcagaagctggtgccaggattcttgtacagcctgcagaacagtgagctaaataaacctcttttctttataagtcacctagtctcaggtattcctttaaagcaacacaaactgagacagatggatagtttgcaaatattttctcccatgctgtaggtggtcttttcacttcattaattgttctctttgctgtgcagaagtttttggcttgatacaatcacatttgtctgttttcgcttttgttactgatgcttttgaagtctaacccccaaaaatctttccccagatcaaagtttttttttttttttttctagtagtttcatagtatcaggtcttacctctaagtccttaatccatttggagttgacttttgtatagggtgaaagatggggatttatctcactttttcacatccactatacttatcttccctcctatcttttttgtatacatggttataggattttcaccagtgttttattatgtttttagaaaacatgttttgcagaagagaaactcttatgaattttctgttgtgcttcaaatcgtaatcattcaaggaatatatcccaaatagctctgataggaaacactattgaacaattagtaagatatgttcataagaatcattatgaggaataaaaacaactaaggttcttaaaaagaaaaaaatacttccaactgtaaaaatatcattttttattagaatgatcttcatttacttcaacacaaataaatttaaagcagcattagaaaatgtagcatttaataaagtctttatacatcctgttctcaactgacattttttccttaagaaatacctgaatttggttgtgacattaaattcgcaaagtttggctctgtatttttagtgccttatttgtgattttgttgttttaaaataaaagctattcagtgtgaataaatttgaattggcaagcagaatggcctactaccaaacattcagtaaccagattcaataaccacatgccaagccagaacattggaaaaatcctcaagttaattaaaacaaaggctttaatatttcttagcatttgcagctgttctatccagagagggcaggcgcctgctgggttgtgttagcctgggattagtagttcaggaaaaagcaaaagcaaagtgagctcgtttattaagttttctgatgttcagtttcttctgtgaaatgggtataatagtaatagtacttaccttgtaggtattcatattattataaaataagaaattgggtatatgaaaaattgagtatggtatatattagttattattcagtgctcagagggacagaggtcattgttctcaaaggttttgctctaagtttcatttttgcttttcatttatggtttgactgcagcagacatctgtatccattgtcttgatgaggtcttaataccttcattgaaaattttatgagaggataataataagctcatttaaaagtttaaatgtccatggtcattatattaaagttctccagagaaataaaaccagtagaatatgtaaagagagatatgagaagtgatttattatgaggactggctcacttggtgaggcaagagaagacccttgatatgccatttgtagctggtggggtaattcagtttaagtccaaaggcctgagaacctggagggtggggaggtgggtggttggtgcggacataagtcctggagtctgaaggcccaagaaccaggagctccattgtcaaatgccaggagaagatggatatcccagctcaagaagagagaaagagagagaattcacccttcctccatcactttgttcattcgtgccctcaatggattggatagtgaagattgatcttctttgttgagtttactgattcaaatgctaatctctcctagactcacctgggaataatattttactaactatctgggcatgcattagctcagtcatgttgacacataaaattaaccatcatagtcattatcttcaaaaagtccctgggactgtgagtttcttaaggaaagtccatatattattattcatgtcactgcctggttcttggttgatgataaggcaatgcttgtagcatgacccaatctacgaccctgtttataggaggcgatggtgatccagtccattattaagcaattagcatttgggaatcaagcacatgcagttcaagagaataccctaaatgatcctttattctcaagttgaactgagtccataggtagaataagattttggagtagcccccttttgtcttcagcttcagacctgtttattcttcttggcctctgcagcagcttctcaaccatccagctccatttggctccactctagaatgagtggtggttgtggtaggttttgatcctgacaactggatcttttatactgccaacattgatcccatggcagtttctgtttgttatgatgctaatagtcttcatctctttttcttctacattgaattttatcactaaattctccttctggcaccaagctttgtatgtgccataccctagaaagatgataaggtggatggggccagggtgaagaaaaagaaagttcatctcatcacaaataaatgaacctacagaacagaggatattcaattaagatctacatttttgtttcccctacacaaaccaccacagctttttcagtagaaaaaatatttttagtggaagctgaagttaccaacatcattgaggttggaagaagaatcttttctggcagctgaaagtaaacgaaaagagtcgtagccactgacagtgagttgtgtgtgaaagcagcaaccccaggctcactggcaaggaataaagatgccagagagcactgcctgattgaagaaaccgaggggagagaccagtctgagatgctgcggatggccagtagctggactgcttgataaatggggtcctggctataccacttcatagctgtaatctatgcaagtcacttgatctttcttaatctgaggttatcaccataaaatggaggaacaaatacttgaaatctgctctacttcataggattgctgttattgtaaaaaaaatgacaaaaataagtagtcagtcaaatgcttctgttagatgagcaaatgggtcccatacaggaaaggaattatggaccaaaagccagaattaatggccatttgtagtttcctgcaccagaatagatttttttttctatgttgaaaactgaaacaatgtgttttaaaataacattcattgtaaggcctttcaattcagaattgagccagtgttttgtaatatataggtacacagcaaaactggatcttcaaagccttcaaataggctttattgaattgatactgtgtttgattctggtctcagcccttggcttgtgttgagacctcctttgagaccctcactgtcatctgtgtcagtatttttaaggatcccttacaagtgtagccgggtggaagcccgtctgctttcttcaatgtggtcgctggtcacgagtgttcaggaaggatggaggtgacacaggtgagccacagagagctggcgtctccccagccactgctgccgcctttgcctgtcagcattctgacagggacggtttgtcattttaccagctgactcctcgactttgacatttaactacagcatcttacacaagactccagacaccttgaatctggcttaattagcaaggctatgcctcatccttcctccccaggtgcttctcccagtggccaactttagagcgaatttagcagtagatttgtaggttgcaagcctggactttgattctggccccttgttatgcagggagggtttctgcctcagcattaaaaagatgaaaacaaatgtctcacagggaagaggagattcagagtctggtggggtcagagagccagatgtgggcaggagacccaccaggaggaactagctaggaaggggaggaggtagaggtagcaatggctatgacagtgtttaggtagcaggagaagcagataaacacagttatctgtggactcatacatgtggatattccagaatctgcaaatggaggggtgattgaggcactgcacagtgaactggtttcttcagtaatttcaggaaaacatgtgacttgttaaggctccttagaggcaagctcaatggatcgataggtgaagtataatcttactagcactacagggacctggttgttactgagatgtattcatagtgattagttaaaccttatgatgatgtatttaattgtgatgtatgagaaatgttactctgcagagtatgaaagaacgactgtatgaatgtatcgaattgtttacttttccgctttcagtgttgtgtgtaagaggatgttgcccccaatttaaagagaatgccactgagtttgtgttgttaaaaagaaggggctattttctaaatatggtgttggatagaatctctatcctcaagtagaaggacaactaatgaagttcacaacctaaaacataccgtcaataacagatgtcaactctgtgtgtggcttacatttttgtaagttaaattgtgtctaatgaatagtctctcacggctgttacatatatgcacaggatggaaagcaaagttcttgcaaaattagattaaaccaaatgcagatgatccaaaatctacaatgaaaaggattagctactaattactccattcttcattcaacaaatattaaagagcacctactatgtatcatgcactagagatacagggtgaacagaacatacaaactccctgctttcatagaacagacactccagtggagtgcggatgacactacagaaaagagtgatgaggaaaatatcatcaggtagtgagacagtgccgatgattctcaaagagtgatcccagattaacagtgtcagcatcacctgggaacttgttagaaatgcaaattctcagcttctgccctagacttgctgaatcagaaactctaggggtggacgcaggaatctgggttgtaacagttctctgggtgattctgacgaatgttcaaggcaaacaaccaggcgctatgcatggaagtcaaattgcagaacgtaggtgagactgctcaagcatttcatttgtattgggtatgtagagaaggcctctgtgcagagctgatctgaaaataaagatttgaatgtcaaggaaacccatccatggttgtggagagagggaacagagaggacagagatcttaagttgggaatgagcatgatttttttttttttttttttaagacagggtcttgctctgtggcccaggctggagtgcgccatcttggctcactgcaaactctgcctcctgggttcaagcaattctcctaccttagcctcccaaatagctgggactacaggtgtgcaccaccatacctggttaattattgtattttttggtagagatggggtttcactgtgtcagccaggctggtcttgaacttccggcctcaaatgatccatttgcctcaggctcccaaagttttgggattgcaggagtgagccatcatgcctgccctgagtatggcatatttgagggacggaaagaaggttggtatggctggaacattgttgtcaggatggaaagtgtctccggttccagtcggaggtgcaggcagggatcaggtggtggtgaatagtgcttccccaatttaatgggcacacacaccatctggagattttgttaaaatgcagattacgtatgattcagtaggtctggggtggggactgagattttgcatttcaacaacctccttggtaatgatgttgtttctgctccacagaccatactgtcagcagtaaaagtcccgggctttggaattataaaatgcaacccggtactaaagctctgtgacggcgtgtgtgtgtgggtttgggtttgttttttaccctggctaattgaactgtggcttacactgggaccttgttcatgacaggcagttgattggattagatggtgcttgagacagttgagaggtgtttgcaattaatgtaaaaggcgagccatgtcgtttagtgtcaactggcagaacgtggccaggtgtggcttgtctggtcctcaggagggtgaagggagaggctttgtgatttctttttttttttttttgagacggagtcttgctctgtctcccaggctggagtgcagtggtgccatctcggcgcactgcaagctctgcctcccgagttcacgccattctcctgcctcatcctcctgagtagctggaactgcaggcgcctgccaccacgcccagctaattttttgtatttttagtagagatgggggtttcaccgtgttattcaggatggtctcaatctcctgacctcgtgatctgcccgccttggcctcccaaaatgctgggattacaggtatgagccaccgcggccggccaggtttgtgatttcaaaacacaactgtttccagactccttctctcaggtcctgtgcccttggtatttctgagctgaccagcagaaccttctctttgtcactgacttttgttcaaggtttgtctccctgctcagatcctgcctcataggctatctagtatttaagtctctttaaaattctggctacccattagtgacccattctgtgttgatgtttaggtttgctctctattcttcctcttcctcatgaataccaagacattgagatcagttgtagcccattccctgctgggaatccaattcccagggctatggactttcagatgaggccctgttccacaaaacacaattcacccagttatattggactcacttttgtttcttagcgtccttatacacttctgccaggtttgatgtcctacctgagcacaccgtgacatctgacaatgaatgatgtgtctctgatttttagtgtcactgggtttgtcctctccaccctaaagttccgtaagtgtatgtgtgagtttgggtttgttttttaccctggctaattgaactttggcttacactgggatcttgttcatgaggggcagttgattagattagattggattggattagcctctcccttgtccctcctgaggcccagacaagccacacctggccagattttgcctgtcgacactaaagtacatggctccccttttaaattaattgcaaacacctctcaactatctcaattaccacctaatccaatcagctgcctctcttggtggtacttggcctttcccacccataattctgggaaaaccctctctctgggagttaatcatcctgcagggagtttctgctcctaagctctctgctgccctctgctgggaggcagagaccttttcccttgctgcaccatggagctctagttctttgagtagcaagcacctgccaagatactccacccttcccacattcattctttcctttcccgttcagcaaatacttattgaggatatcctgtataccaagaactacaggccctgggatacaaggtgaataaacttggctcctatctcttaggacctcactaaggcgaaagacagaagggttaataacaattagaatatggcttgagaaaggccagacgagagaaagcagaagataaagggagactaggagaaaagaaacgttagcaatgctcacaggagagaggaagccttcactagggttttggcagctgagctgagttttaagggatgggcaggagtaggcaaattgctggagtcttggatttatagactaggagggatggaaaggatactggaaattacattttggttgacttaataatgaaccatccattgtcctagaggacaatgtcatagatcattcaaatttatatcttttccttgagggttaacactggggttttcttatagtcctgctgccttgtatttaagcatacaaatatctaagaagaaaaataagcatcaggatttttctgtttaaaatcagaccaaaaaaaaaaaaaaaagatatagggtcccatgatctctgtattttttggaacttgagagattgtatgtcctacctctcctaaaagctaaggaattggatatttttcactcttgtattatttggaatttacctgctatgaaccaaataataagagtaaatatattatccccagaaagatgttttgttactgttgctggtgaaaaaaatgagctcactaacattttaccaccccccaccccaattatgctgttctttcaccggagcagtgctcatgaagataactgacagtttcaatagttatttgtaaaaagttggcatccaggctgggcatcctgcctgcagaatggcataggctgaggatgaatggtaagttaatgagcttatctacctctcaacccccagcatgaggtaccgtaaacagcatctggcttagtaatagagacggagaaacaccacaatacaggaagatgaagttattacattcctacctggataaaaatgaaaatggagaattctcagctgatcgatcaaaggagcatatgtctcaccatacagtgtgatctccttgcggctatgacccttgtccctttttatgtacctggctcctctcatacaacctggcccttagtagctgcttccaaaaagttagtttaattaagttgaagtttattgccctttaaatggaagcatgctctttatatcttcctggttggtagagttcctggaaaaaaatttgcttagctgcatatttcatggcacatgtgtagacttgtcacaggaatattggagaggaccttcctggagtttagttccctttctgaagtcttcaggctctccacggctcttaacagtctttctaatttgattcagaaaaaatcaataataaaccactaacaacctttgccattccttccctaggatttttctctttcctgaaatagttcattggtaactgagaggtgacaccaaacatgaggcagatagaaagcgatatcatgacacaccatagataaaagtccacttttccctgaggcgtgaacacccactgaaagaaatatgggggaaatcagagagaagattcctatggaagctctatgctctgtctagtagagtaaagtaagtaggtctgggggatcaagctttccactgaaagaacctcttagccttttataatcatagaatgtgggactggagtcttgaggtattggtattatcttttcaaatgatgtgtttttatgagtgatgtatttgtgtttggctataagaaaacaaatctactgacttatgaaggctgacagagaacagggctttatttttcttatacgaaggacacaggcaatgtttgttcagtggctcaaaaatgtcaggaacacattgttgctcccattatttctctgcttattgcttttacctccaggccaccctcccttccattaaggcctgaacccagccattctctgttgcttatggctttgtggttgcaagaaggctgctatagctttagtcctcatggccaagttcaaggcagaaagtcaggggcaatggtttaggccacatcgtcgctttcataggaaagcgaaattttgctggtagtttcccagatggcttcctcttacatctctttagccagaactggcttcatagggccacccctagacattaggggagtagataaagtagatactggatccactactgtcatggacaacaatgaggggctgtgagtaacaaagaggtggaggatgggcattggcaggcactgaatggtatctaccacaggtgaggaagcataccactactcaacactggtggacagaatatttttaaaaacacctcagtgtttatatgatgcaaacaagtaagtgctagattattatgccaattattaccccaatgccctgatagaatgtaaaacagaggtgggttatctggttttgaccactcttgacacctgcaattggctccagtggtcaggtagggtcatccccaatgagatctatctgcgtttttacatatacaattctaacagctaattgtattgaactgtgtagtcaactagtagtatatttgtcttgaaactttccagaatcccccagattcatcaacaatgagcaacaaactagcatcacgatgcaggtattggctcattgaccacctgaatgactaattccccacacactagctcacagtggaggtgattcaaattagtgccttagcaaaattacaaattgctacatgtcatgctcctccaggatctctcacaaattgtcaaaatcatgcatgttaaatttgcaaatgaaaaaatgcctactgtgtattctttgaaatgctttcatgtcatcagcaaaattggtgtacaatgacaattttttgtatttatttatgaaagtattgaaatggctgcaatatttgtagtattttgtttaaaagaggtaataagaggcctcctccaccccttgtcctcagatattgttccacttcaaagactgaatttccttcgtcttacaggcttgaatctatcctgtagagtggttgtgaaccagagtcctgtttaaaataaatcatcataaggtagctggattcaggccttaataatagaaatggtgccctggaaatgaaagaggagcagagtaagatgattgacctagttctgaagaaagggaggtggtcaacctcaggggatgggctgggaattgggcctataagtctcccttccactttctgtcttctctaccccattgtcccttccatattttcctcttaaaaaaaaaaacactatgggctacattccagaaatgggagtatgctaaggtgcctaggcatgtacatctgtatccatacctattcccataagtacacctatacctatacccacacctatctatttgtactgattggtattaggccaacaaaattgccaatacatttgtacttacaaaatatcaaggtttatataaatatgacagactaaaaaccagtattgcagtcacagattttattgtctactgggtaatatacaactctgtaagagtggaaggccgtgcattagttgagccatccccctgattttgtacctaatgttctttcaaaaacttgtgcaaaagtcagctatgaaacttcaatgagattacatgtgggttctgttactagagagctgaaaaacattctaacgtccctaattacaccttagcttttaggcatcattctcgatgatttatacattccatacaaggtctttcattttattatttcctttcaaaatagagcacaagtttgaccagcttgaagtcaatgagcatctgattgaggctaatgacttaccactttccacaggcctaatgatttctatctttgtctctattgtattgagttaatgagacctatgcttatgccaggaatcaacattcatttttctttctccactcatttttgtaaactaataagaacaaatgcaataaaatagttgtataattgcacaaacattgctttaccttcaaatatggagatactactaaaatggaaatattaattggctaacaatgctactgtgaaacagccaaacatctacaaatatgaaaaagctgatgaaatgtttgtaagctgaatgcatggaaattaaacagtccatatgtagttttatagttggctctcgattgtatactatgtgtacaaaaactagggtcaggatctagaacttctaattccgaatgtgctcattaatttacttggcaaatatttattgaatttgttcaataaaattgaactaataccagataggcctggagcatcttctgtgccagaatataaaagagttctcaaaaaagccccacaaaaattagcatatactcttatatgtgatatactgtactaggtggtagcactctgtttcatctgatcctgaactaaaacccttagtgacaatcctctgattctgacttgtgtttcgtcttttttgacgcttctgatgagctctttggctttgtgtctggtggtttttgcatcggtgctgcttttggaagaggctttctggttgtgacatctgcctacttgaattcctttgtctaggggtaggagccaggccattttagagtccaagcatttctgctaatgtggctgcattactctgcaaagtgggcaaggagaattaagagaatctgtattgagtgacaatgtcaaatggatacagaccctacagccaagcatcaaaatttagcactcttaagtgataaccaaatggtgagggaaatgttttttttctccctctactcgtgtgtgtgtgtgtgtgtgtgtgtgtgtgtgtgtgtgtagctgatggtctggtaggaaaaaaaagccactctgtcatttgtgaagtggcatggaaaataagttttctctatagggagagcttgggtgtttggaagtcagcactgaggtagagtttggtgcacaggatgtttatcagatatcagcacctgttgaatggaggagaaagaagcctggttgggtagagggaaaagttgaactgtaatgtaggtctggcaaagctttggctgactccagggagagctctgagcatatgttcttcatcgcagttgaccctgatgtactaaaacggtcgggcctttacaacacccctctatcaatcactgaatgtgcgttgccccaggaagaatgtgcccttgggaaaggtagctctgtggctgaggcagatcctgaaagaaatgataactggggtaacgagtctttccttgatgggagatctggtggggacacatgtcgatatgacaaaagttcttagtaaactgagaatagaggagaacttcttcagcttgataaagaacatctaaaaaaacctaccactaacattatatttaataatgagaactgggtgttttctctaagtttgggaacaaagcaaggattttttttctcaccacccctaatcaacattgtactggaagtcttttgtagtgcaataagacaagaaaaggaaacaaaaagtatacagattgagaaggaagaaatgcacctatctctgttctgtatattgtctatttagaaaatcacaaagaatctactaatcaataattatggcaagatcacaaaatataaggtaatatatagatgtcaattgctttcctataccaggaacggatgattagaatttggaataaaaagataacagatattaatagtgcccccaaaatgaaatacttaggtatatatctaacaaatatgtatagaatctctatgtggaaaactataaaactctgacataagaaataaaagatcaaactgaatagatagtccgtgttcatggattgaaagactcaatattattaagatgtcaattcttccctacttgatgtacagattcaatgtaattcctatcaaaattccagaaagctgtattttagatattgacacactgatctaaaatttatgtggaaaggcaaatgacccccaaaaaccaacacaatgttgaaagagaagaacaatgtcttactgcaagacttgctacaaagctatagtaatccagacggtgtgatattggtggaggaacagacaaacaggtcaatgggacagagtagagagtctagaagtagacccacacaaatatagcctaatgatttttgacaaaggaataaaggcagtttaagagaaaaaggatagtctttttaagaaatggtgctgaaactattggatgtccatatgcaaatcaaaaccaaaccaaaacagaaaaacccaacctagacacagaccttacacctttcacaaaaattgactcaaaatgaatcatagacctaaatataaaccacacacttgtaaagcttctagaagataatacaggagaaaatctacgtgaccttttatttaccaatgggtttttagatacaataccaaaaacatgatttatgaaagaaaaattgacaagttggaccttattaaatgaacaaagtctgaaaaagtggacttttaagagccactgttaagagaatgaaaagaaaaaccacagattgggagaaaatatgtataaagcttatgtctgaaaaagggcttgtatccaaaatatacagagaatccttagaactcagcaataagagaacaaaaaactcaatttaaaaagggacaaaagatctgaatgatcacctcaccaaagaagatatacagatggtaaataagcatatgaaagaatgcaaaccatcatttgccattagggaactgaaaattaaaataatgagatatcactacacctcctagaatgactaaaactaaacaaagaaaaccacccgatagtaccaattgctggcaaggatgtggagcgacaagaatgctcgttcatttgtggtgggaacgtaaatggtactgtagctttggaagacaatttggcagtttctcgtaaagctaaacacagtgttaccacacaatctagcagtacactcctagttatttctccagctgatctgaaaacttatgtttacacaaaagcctgcctagaaatgtttgtagcagctttatttataaccaccaataactggaagcaaccaagatgcgcttcaatagatgagtgggtaaactgtagtccactcattctatggcatattatgcagagagatgaaacttaaatgcatattgctagttggagaaagctagccttaaaaggctacatattgtttgatttcaatgatatgacattttggaaaaggcaaaactataaagacgacacaaaaataaatgattgcgaggggcttgggtgaggggaagggagggttgaataggtgaagcgtagagttttctttttagggcagtgatattattctgtataatactataattgtgacaaataagattatgtatctatcaaaatccattgacctttaacacacaaacagtgaaccttaatgtacacaagtttaaaaaagcatttaggaagtcatggaaatttaggatggaacatagactgtgacacaacagtctaactgtatcacagtatgtgaaacaatttcactgaaaggagttggggaacaggtactgacctaagtaactttggaaatgagtggaatttgtaaaactagaggcaaaagaattattgtattttagttgataaatttgtatctcatgggagtgtgggttagcaattcagatgcttttacacatctgtattggaattgaactgatgtcagcttaatagatatggatagttacatgaagaaatatttgtaggtatgtgtatgtacttgagttggtatacacacatatatttccttgcttgttcagctgagtgggcctagtgtcaacaatgtcccagtagcaaccagtgcacctggtacccagattatgggtaccaggaagctaggtcttcctggatttaaagacttggagcaggaaatacaccagataagcctggagcatcttatgtgccagaaagttctaaaaaaaaaaaaaagaaaacccacatttagttctttaaggaatttccataatgggtgtagtagtttacattctcaccagcattgtaaaagtgttccctttcaccacatccacaccaatatctactattttttgattttaaaattatggccgttcttgcaggagtaaagtggtattgcactgtggttttgatttgcatttccatgataattagtgatgttgggctttttttatatgtttattggccatttgtgtatcttgctttgagaattttctattcatgtccttagcccactttttgataggattatttataattttcttgctgatttgtttgagttccttgtagattctggatattagtcctttctcagatgcatagtttgagaatattttctcccagtctgtgggttatctgtttactctgctttttatttcttttaccatgcagacgttttgggtgggagtgcgtgatggataaaagactgcacactgggtacagcatacactgctcgggtgatgggtacaccaaaatctcggaaatatcttctttagtgaggtaatcgttcagatctcttgcccatttataaattgggttttttattctcttattgctgagttctaagaatcccctgtatatttcgggtacaatccctttttcagaaaattggaaataatcactaaataacttatccatgtaaccagacaccacttgttccccaaaaaccgactgaaataaataaaaatcccacaaaaacaatccccaccccaaaactctccccctcaaaacaaagcaaaacaaaacaaaaaactccacaacaattgggtgtgtcaaagagacatagaagacaactgcaagagctcccaatggccaactggggacaatgtgctctataaaatagagtagtattggattatagcccaaggtatgaaatcaatatccatgcattcatactgatgtaaataaatgattaaataaacaaatagatgggggggatacacaaatatcctatgcagaagaaatgcaagtaatttatgtagatactctttgctccaaggggttggagcatggctcccatttctttagtgtgggctgtgcattgtgacttcttcaaaagagtgaagtctggaaaggagaggaaggggagtgtaactttgcattgacaaacctggcaaacacgtcctcagttggaagattaaggtcaaaattaacagtgacaaattatgttgatagcatgcacctttgatatgatgtgatgagaatgtcactttacctctgtggtcttcttctctgcaaccttggtttaatcatgagaaaaagatcagacaaattccaattgtttcacattgtacaaaatacttgaccgcaacttaaaaactgtctaagtcttaaaaaacaaggaaattctgtgaaactgtcatagcaaagaagagcatggagagacatgtttgggtgggatcctgaaatactgaaagaacattggatgaaaactaaggtaatctgaataaagtgtgggctttggttaataataatgcttgaatattgattcgttaattatgtcaaatgtacaatgctaatggaaaatgtttataataggggatacctggtgtgaggtttaggggaactttctatactgtctttgcaattttttctgtaaatcttaagccactctgaaatataaagcttataattaattaaaaaatgcacgccagacattgttctaggcactagtatgggtaagacatgcccctgtcctcaaagagctcaagttagtgagtccacaaggtatgtgaaaatacagtctagtattcacgtcagagacatgggcaaagggttttggaaacctaaagtttaaaatgaattgtctttaaacctaaagtttaaaatgacttctaacccacattttgtgaaaaagttaatgttcttcctaaaatgtgaaaagctgattgggggtggtggtgatcttatttctaggaccaggtttctcttgctgatgagctcattcccatctcatctcccaccgtgtattatttgctcacattcatgcataccagacagggtactcatcctgtttccttcttttttgcccatggacgtgtattgtcagactttattgaagatggaagatataaaagatgtttatgagtcttaaatacaaaaatctttaaagtatagatttgaggctctgttctttaaatttccttgaccattccaccacaaagaacctctcaccagcactccagtctgcaggctcctgcttcctgccaagagtctggtcccatctcacatcccttgccaacctccaatattctggatgacttcttttgcagctaagtttactgttctgtttatttcttttctcccttacaaggcaggtttgggatctcaccttcttcactcaaagcaatctagcaaagttgtttcttaataaagatgagttcttctaaaaaaaaaatacccaaacaaataaaataaatacataggtgccaactgttaaaatagtagtttcttcgttcggctacactagatcagtaaacaaatgatgtgtttcatttgggagagttgttaagaagaaggaagtgcctgtttttttttcttctctcttggtagttctcagaccactttactttcatttggtctgttgcaacaccccaagatggcagcctcgtacttcagttctgtgtgatgttttggatcagctctttctatttgactcattttaatcaaagttttgtccacttctcatcatccaatttgaccagggggataggggcaagttctccatgggcatggccagcaatgcctcagaatattagttgtccctgttgttgggttattacttactttattattcaggacagattccctcagctagatatagccataccctacagcggttatgtaagagtctgtagttttatacattcttctttcttttcacttgtcttttaccttgaaatgattaagaggggggtgtatttcttcaagggtctatcccagttagaaagaacttcaaggagaatattattcgtgactccttttgttgtgagctacaaaaacatagtgtcaactactttaagcaaaagaggaaatggacagtggaatagcttccaagatcaagggaagaactacaggatacagaaccttggcagtgagatgtatatatgtcttcccatttctcatctctcttcttttttctttgtttggcttctctctgcaggcaggtccttgctttcaggcccggattcccatcctcctagctcagtgacccctcgcagaaggaaagtgcctgctttcatgtgatgtctgtgcattagttccagggaagagctctgggcagcccatcttgagtaacatgctctcttctcggactagccaccaggggcattgtggattatgattggcctgatctgggacccttgccatcaccaaggggagtggcttagggggctatgactgacagcctcagaatgacaagtggtggatgtagggcaggcaaatcagccgatgtccattactgaaaggatgctgtattttcctgctgggataacaagtataaatattaggttggtgcaaaagtaattgcggttcttgacattactttcagtggcaagagagacactgggagtagagagtgaggttggtgaaccttgcaagttgaagctttctctcctcagaatcacttagcctgtgcctttttctcagaaagaagagaaaacaaccccctaggcatgaaggattatgtgatttgggcagcatgagatctagataaactgtgggaacaacttcaaggaccactggagactctcactgggatacggggcctcagctggacctgaaatctccatggggatgagtgtggtatctttcgtgcacttgggcttttttctgcgaaagccccctctgcagtaggtttcttattctgagctggcctggaatctcgcagctggctacgatttgtggtactcacaccctgggcttcctcaagtctgggcaaagagtatgaaaaggttattatttctctcctgcctgaggggttggaggcctcacctcctggggccgttcctagctctgaataagaaagtgtctaaagtagtagcgtataagcgtctttttttcgtattaatggttgcagtggattataaaggggaacccagcaggcgtggaagggcttgcatccatttcaaaagctccagtacattcagaggccaaagaaagtcctttgagagtgccctgtaaagagtgttgccagtagtttttgtaaccgtaagccctggcagggattctggaccaaactgatgtcatttcattttccattccgatcacagtctagtagagtcaagtggaagtccagctggggtctcgtttttagctttaagagaaagccatacaggactcattcaaaaaacttttgtgaaggtctttccattggcaggacctggggccaggattggggagctgcatgcccctatcctcagggagctcacagtttaaaccatagaagttcgtaagtcgtacataactatagcataaaactgcataggaacagaactctgagagaggtagaagacaatgactcagtttggaggggagatactttttttttttttaaccaggcaaggtcatggggtatgaagtagagaagggggatggatcacaattttatcactggcgtgtatccatgacctccttggagtccaaagagaaacaccagaaagaaacatcaagaaattgtctcttttgccaaatctaagaatatattagcgatgtcatgatatttcctgaacaaagagatatctcagaattgcaataagggagggtgttttaaaagagctatgtacaaattaaaaaaacattttttcttgttatagtatttcccaatactttccgaatttagacttccctctcccttttctaccataagccccatccatgtaagagatgggaagagtggtagaaggggtaaatctgccaataataatatatgttctaattaggagagaataataggcggtcttgtcctgtgatcttaccttcttgtgacattgaaatcccactcatgagcattgaaaatattcctgatagagccaggctagagttgccagataaaatacaggacagcagctagattttaatttcagatgaacaaagaataactttttatagtagtgtaaatatatcctgggaaccctaacccagactcttttggcatattggcactagatgcatggcttcattggatcaaatgattatccatgtcacatgtctggccaaaaaagtctcaccagtcctgttcctatcctcgctccccagaatataatagaagggggatctttgttatgcttagggcagagcaggggaaaagacactggctgaggacatataccaacaagaggttaatcttgggtgtgttaaaagtctgattgccttttgaaactccattctagggccagaccttagtgagggcttcttaccctgctcccctccaccacccttaggaatcaagggatctccttctatctcagacctatgccactggggagagtgggatgattgacaactcatgcttgaggcagagaacatggaaaatggaatccaggagagggtaagtaaagaggttgaaaggatgagagttaaaatgagacagggcacaagtcaatgagtctcctcagctggtcatgaatggctggtcctatgggggctgtcctgaaagtctacaattagggctccacacatattgaaggagctgaggccatgttgaaaaaagcagtgcttcttaatttttaatatccacagaaattacctggggatcttgttaaagtggagattctgattcagcaattctggggtgggctctaaggttctgcatttctgacgagtgtctaagtgatgctgatgctgctggaatgtggcccacattttgagcagtgttaaagagaaattgcaccaaatacttgtgaaaaatgtcaaggaagactttattcaagactattgcaattggggagagagattgaactcaacttcaaatataaaagggacagctggggacttaaagccaacaggcagggtgagggagaggatagaaaagtattaagaagatcttggttaggtattcagggttagggaagaggaactggattagatgtcaagggtgggagaattgttgctaaatggcttagcaggattcttggtaaaactgggtccaaaggccaagggcaaggctcagtcaagaagagggttctgtgaggggcctggctaaagtttggtcaaggaggcagtacttgttagtagcaagggaccagagtagagaagtttctaacaaacttctctactctggtggatggtctcccccatgatgttctcatgataacgggtgagttctcatgagatcttatggttttatgagtgtttggaagttcctcctttgttcttctctctccttgcttcccctttatcttccaccatgattgtaattttcctgaggcctccccagccattcagaattgtgagtcaattaaacctccttcgtttatagattacctggtctcaggcagttctttatagcagtgtgagaactgactaatacaacatgttgataataacttttgttaaaagataaacttaaaggtcaggcatggtggcttatgtttgtaatcttaaccactttaagaggctgaggcaggtagattgcttgatgccaggagcttgagaccagcctgggcaacatggtaaaaatctgtctctacaaaaaaattagccaggcatagtagcacatgcctatagtcccagctacctgggctgaggtgggagtatcacttggagtgatgaaggctgcagtgagctgtgattgtgccactgcactccagcctgggcaacagagtgagacagagtgagattctgtctcaaaaaaaaaaaaagataaattttaaaatcaatagtgattcatgagtcaggcagctccagactgcaactggtttggggattcactggaggggcacaagggtaaggctttgataggaaacaaaaacaaacaaaaagatttgttaaagtggagcagtagctctatttggatcattccagaggaaagtcccagttaggagatagcagtttttgattggcctaaaatatgaccatttatactgagttgggttttggtttgcttatgtagaaacccaatgcactggagctgcctcagtcttatggcttctcaattaatcattttaacattgtagaggccaaccaggagaaggctgtcagcaacataatctagttgaaaagaagtctggattaccatcaggttaccctgtttaatggaaatggcagttagaaatgttagacgcctgttaacagaccataatcctggagaaccaagggggaagaaatgctggtcatggtggttgtaactctggatccctgacctcaagtatatagcattgttataccctaactccaatggaatgatctcttaagcttccttcattgtatttatggtctttattttaaaaaatatatacttaaaaaatatatatatatatatactttttctgaccggtcgtggtggctcacacctgtaatcccagcactttgagaggccaaggcagaaagatcgcttgaggtcaggagtttgagactagcccggcctgcatggcgaaatcccatctctactaaaaatacaaaaattagccgggtgtggtggcaggctcctgtaattccagctactcgggaggctgaagcatgagatttgcttgaagccagggggtgaaggttgcagtgagcccaggctgggtgagggagtgagactctgcctcaaatatatatatgtatgtgtgtacatgtacatatatatgtatctttttattatatataaatatatatatctttataacatatattatatatacatatgtatattttctgaatgtaaaaataatatagcatattacagaaaactggaaaatgtggaaaatactaaaaaacacaaatcgttgtaagagaagaccactgataacatgtatcctatatatatgtaatgaatatgcatgcctgtgtgtgaatgtgtgtctcgttacatactcttataatttccttcttacttaacaataaactgttaaattgtgaacattcccctgaggatcgtgcattgttgatgtgttacagatactgagacaagattcaatatctcaatccttccaaggaaagaagctgaatgcatgcagtgatttgcccattcaacagcaggaaggtctcaagccaaggttatctcatctcaggagctcagccacagcatttcttttaggccccgcagggcagagatccttctattttaaccacattgataaccctctccattattttcctccacactccatccctggtggaaaagcagcccctggaatctctcttctgatttcccagggaatccctactggctctttggggtagacagaagggaatgagttcaaagacttcagcagagaatgtagaatggaggaggattgtccccacatgatctgggctcattcttccattccaggccaccttctgtagcctgaaagtcccctgtgactctttctttttctgcatttgccaaacatttattttgtccctttatttaaaacttcagtgttgctttgttgctttttaaattagaagacaatgattttcttctttgcgaggcagagagagaagatgtggaaagaaaagctcccaggatttagagcatggatattaggatacttcttcatcacgtctttcttgaagatgtgggtatgagccatggtaaaattaagagtggtcccttccagatgacctctccagtgaccttgggcacttaaggcactctccttggctctagcgtttttatttgagaaacgggtagaaatcatttctgtctgctcacatcagagaaataggtgggaaatgctgaatggaatataaagtgctaatcacaggttggtggttgttattattgatgttgtttttacttctgctgccatgagcagtgttatagggagaaaacatatgtttttaacaagttttttatttttcaaataagacaaagaaatggtaaaaatatagtataaaggttatacagtgaaaactgtctccttcccactatcagtcccttctcagaacagtagataccttcaatcagtttttctgttttcttccaaaaatgttctctgcatatacaagcatatgcatatatgtgtatgttgtattttttttaggtagtaacccatcctgcatgtttctatttgttgttcgcttgttattattccatattagcacattccattgcatatcattattgcatattcactgcaatttatttaaactttcttctcatggtagacattgagtctgtttccagggactggctatttcaaattctgtggcaatgatcaccctgtgcactcgtgtatctgtgcaaattgatctgtatcataaagtcttagaagtgggatggctaagtccaagtgtataaacactttatattttagtagaaattgccaaattttcctctggagaaatgtgcacaatttacatttgcacgaatacattgtttctatacaccctcaccaatattgcatgttgatctctactaatttgaatttgtaatgctaatcttattattattgtttaattttgtgtttctgcaagactgagagagcttgactatctctcttttcatatacttaaaagccatatatttgtgcactgcttgcatatgctctttttccattcaaaagagcacatattaagagatcgggctcaaatcggccggctcagcagggccactcttcccaggcttatctggggctccttcccagctccccggctgcttgtctctctggtctcttgtgtctatgctgctctggcagtcacagaagccccaggccatgtatctgcactagtgcacccatccatttaccctgataagtgaaagctgactgcacaattctgtgttatttatggcttttcttccagctacaaaaagtattttattcctcttcaccctgggagctgatgtgaggcaagtgtcttctaaattttatagtatagcaaatggagatgtgaagacatgtaattggccatctgagcacctagtgagacaactgctgagtctaagtgtataagatgtttgactgtggtgatcacatcagccacaagccggctcactggggtgcagaagcagcaagatgtgggtggaacactgtactttggagcttgaagatatgtgggttctgtttctagctggaacatggatctgttgagaaagattgggcaggtatgctctgtctctggggctcagtttcatcatctgaaggccttcagatcacagtgaagatctgacagctgtggaaagagaggggaagggaggaggttttgttaaaaagagcctcagcctgtagagtaaatctgagaaggtctcactgtactgatgtgtagctccaaagtagagatcacccattagagcagtgtatgccagacagaaactgtctggccctagtacccctttgtgtccagtcattggccgggagctgcccagggagaccttggccttggcttgaccactggggaacacccctaatgctctgcagctagaggtgccagctgcctgcactgctcttggcaaactcacttgagatctgggcagtgtaccttggggcctggcacaagaaatttgtttgtatagtttaagggaatttttctgggtccctccaaaagcattgcagatctgaagacataattactacagggtcaaacaatattatattacccctctcctcccaatattttctcatctattaaattattagaatacttgctggaggtaatcagctctttcttactgtggaatattaaacatatatttcctctattgtacataaaatctgtaaaaattgatacttatctgaacataggggtgagtccaagtatgaaaacaatgagaaaaatattgttaggtgtttatgggaaggggggtgcaataagcacagatttcacaagagaaaataggcacatggacttttcagcacagcccatgttcgtctaggtcctctgagaagcagataagactggattaaataggcaagaatttcattagaggaaaagtctgtgagagaaaaatgtagacggagtcaggaaacaccatgagagctgccagattgccatacgcgtgtgcccttgaagtgaaagagaagaggaaggcaggctgggtagagtctaaggatggggtagtctactaaaggttcatgcaaggccatagggaagttcatgagtcacactcctcatcagaagagttctgcatctcccagcaatggacctgccttagaatccctgctgcacccagtaagcagcagggagcaaagcacggaagtatggccttggcacaaatatatccatggatttgagctcacagcatctggagctgttggtcaattgtgattcctttaggtagagggctaggaggggcattctcatggctgccacataccttgtgacatctgacaacattctccatgactttgtccgattatgagtggtcatgtcactttgctgtaagtagctgcatttgagacagttgtgtaatattgtccttgtggaagaagttttttgggatttgcaagttcttaggatctcaataatatatatttttgagataggcttaaagtgcctattaaaaaaccttgtcacttctccagctctgttgctttattggaataataaaatgtcacaagtcaccatacattgcaactatctcggtcttccttaaattatcctaggaccccaaaggtccacatagagacacttttggtgccccatatctcatgcctatgtctgatttagccatggttgtgggggacacttctgtgaaagctcagattcatttggtagcatcctaccagtagcacagaagtgtggagttcctttctgctttctgccctcggagtctatctgagctgccagggtctgcttggctcatgaaaaggcttcctggaaatgtcagggagtgaatgcccttgaggtcaatccttaaccaacagaggatgggagtttgtggaagaaggctccagccctttgtctttcagatgggtagttttgggaggcattctgtactcatctctggagttccagttcagaaattgagcccctttggccaacagctctaaccctaggtgtgcatcctgacttggtcttccagtcctccctgtcttactttccctggttcctcacttcttttgtttaataatctgtgatcacctccaagtgaagcacatgcacccaagtccttgtctcaagttctgatttcactggagcccaaacaggccttataggccacaaaaccctgcagagtgtgtcctaataacttagatagcactttgggacctttccatggatcatgaatgaagagaggggaacttttctcctttctgctcatgctttctccacacttctgtgaaatgatatggtgccttgctgggaggggcctgaaattgccaatcttaaagtcattggtacaaagagataaaaggtgagttgagcgaaaccccatgattctcaggtgactaccctataaaaagtggcctagatattgttacttccctgcatctaaactgatatcctcttcatttttcttcagcaaggcccagcctgggaccatttcctcctaaatagattccacataaaattcacagcctgaactatggagctctcgcaggcatcaaggttgcggtgctctcagtaatccctggctaccctcagatccttgcttcttgactatttccttaggcttgtgatcattcttgattctgacttttatttatgtctccttggtgctgtgtttgaaaagtctacaagagacttgatcactaaagctcactttaaaaaaaatttacaaaattgtggtaagatacacgtagcataaaattaagcattttaactatttttaagtgtacagtttaggagtattaagtgcatttacattcttgtgctaccatccatctgtggaattcttttcatcttgcgaaactgaaacgctatgcccggtgaacatgaactccccatcccccttatccccaggccctggaaactacccttctactttctgtctttatgaatttgactattctaggtgcctcatataagtagaatcacagtgtttgtcttttttgtgtgtgtgactggcttatttcagttggcttaatgtcctcaaggtttagcagtgttgtggtatgtatcagaagtctcttcctctttatggctgaataatatcccattgtatggatataccacattttgtttatccatgcatctgctggtggatatttggtttgctttcaccttttggctattgcagataatgctaccaagcgcatggatatgtaagactcacttttgatgaagttttctccaggaagtcttcccttgtacacattctatctttgtaagatgatgagcagtggtgttacagtgtctcattcatctttatatcccattgaccagaggactgcatattggacacttaaatcagtggctgttgaattctttgattccacacgtattgttttccccagagctgaagggatactgaattcccaaagcagtttacctatagcattccaatggactttatgtagtagacagctgtaatattctctgtccaaccctaaactccttgagttgggagatgttctgtaaatctttgctgtgaaaaggaatgtttttccctgtccatgcttcttggccatatggtagtaactccagcttgctccccagctctcacccttctctgacatctctacatgttctgagcatctggtgaattgacaagtcctcctagacttagtgtctcttgctggagtctcaaccaatttctgcccaaagtcctggcttgaccttggaaattctgactcagacctgcaattaggccctggtagctaatcatcctcatctactgacaataagaaacaggtttgtgaaggaattaactgagatggggtatataaaatacctagtagagaggctggctcatgcaagtgcatagtaaatggttattttttattaagtataatattgtttattacatacaattatatattgtatacacaaatgtatatttgtgtatacacatataatctttttattccttattctcttgttacctcaaaaaatcatttaaggtgtatgaccctgaaaattacatattaaaagaattattgaagtaagaacaaaacattagagtagtgctttagagataggaagattgtagtgtcctagaattaggatatgattaggacataattctagaacattacaatcctaattctaggatgttacaatctaggctaaggatagttgtggtgcttaagcattaaatttagctctgagccaaagaaaaaaaaagaaacaaaaaaaaccccttttctattatctctcatatttcaaggaacagaaggaagaagacagccgccttcacgtctgagtaatgagtcatagtgggggccctgatcacttctcttgaaatttgctgatgagaatgaagtgacagccagggtgaaagggatggcagagggatgcttgcttctctgttttatccttgttggaaagaagttaagttagaatgagaaaaataatatctttttttgggactgttctctttgcagtggtcatgggcttagaagaccaatgacacttcccagatgaaagagttatgaggctgataaaaatgatgtgtgcatgagcagatggtaccgtactggtgagacctcagaactgttgcgtgtttcttggcctaattggctggatcactcttcttggttactaatattaatacttcgtccaggcatcttcccagtatgatttcctttgaagtgttgcttaggtttgaagttgtgtctggtatgatcagattaagtagtttgtcttattgaggatgtcagaatacctcccttagacgtacccaatcaatattactagaagcactccatggggcccttcttcactatgtcaccaacccagggattgggagaatgacaccatcaactcccagattaccatgtgatgtcagtcttacatattctgcttccattgtgatcaatgcctgagatttcactgtcagaacgtgacacccttagcataattcaggagtctgcaaacattttctatcgaggctcgataataagtattttaggctttgcaggtcacacaatctcttttgaaattactcaactctgctttgtgggacagaagcagctgtagacatgtcaatgaatgggcatgactacgtcccagtacaactttatgtatggacactgaaatttgaattttatataattttcacgtgtcacaaaatattattttttctttgacgttttccaacctttaaaaaatataaaaaagcagtcttagtttgtgggtcatacaaaaacaggtggtgggcgagatatggctcataagccatggcttgcctactccttgcttagttgaaatatgaatctctctaagtagaatcaggctttaaactattatctgtcattggaatcttcttgtgaaagaaaggactgtatggttgagagatagcaagagtaaggagacatttttaagtgtgaggaatctttgaggccactggagccctgagttccaaaaatcccaggagagaattgaagttaaggtataacagaaagaatgttggtcttggagtgaaagacctttatttaaatcccaactcagtcacttccttgctgtatttctggggctacttatttgatctctctgagtttgtttcctcacctgagggtgacattcttacaagacagcagtggggattggaaaaaatcaactgtctagtcaaggcttaacctgttgttgctgccccccataacttagggttgattatcatcttgacttaattttgcttaaaacactaaaggagtgtactccatggatggggtaggaagctctaaaaactcctagggcacctttaaggagcaagggagtccatctgtgattagtgagcacagccagaagagcagggaaagggcagggagggggatgaaaactgaggtagggcctgtcccaggaaggtcaggggagcagagctataggactgggagcttggaaggagcaaagcaggagctaggtcagccataggagaggcagaagcaggttcagggcagttcaggaggcaagaggcttcaaatggatttggggggcttagaagcaggattccaggatcaccagcattcccacctgaaagcccgattagcagcaggcagtgtgcaaaacccatcattttctcatcttcccaaggctccagccagggcctccctgcccagtttcattcagtggtaggagctcactaatgcctccctgtcactcagaagatcagatgttactagcactttgtacatcaatacaactttgatgttaaatgaatgacgggctgcatcatgcaatggtgttctggttggaatccttcggagacttctttggagtctctacaaggagcagagactcttacactgtacttacattggtcaaggtaagtgagctctactgtaaagatgcaggatagtgttgtccaatggagctttttacaacgatggaaagttcttcacctgcattgtttaatatggtagtttagcctcacatgactgttgaacacttgaaatgtggttagtgtgactctgaatttttaattttaattaatttaaatttatatttaaatagttaatggttactttattgaacagtacagatgtagatttcgaagaacattttgaacaaatgttctttgtctagtatccaccaccaactggcaacttccttctgtgtgtcttattttcaattcctgaaacagagggaaaaaatctgaagggtctagttcacctttgcacagcctctagatcgaccacctttgggtcaggttcttcagtctgcttgtggcttgggatggggtaagaccttgtgttatgaatacagccccatagggagctggactgtgggtgagcagaccctcttacaaaaggatggggggagtctgtggccagggcaagcagtgattggcattgctggtaaagacagagctcttgtgagtcttcagagggcaaaggagtttataaggaggtagattgcatctcattcattcatttaaccataattttattcaacaaccactataggccaaacagagtgctagaccctggggataccgtgacatgtgaggcagatgtgatcccttaattaccaagctcatggattagcaataggagcagaaaatcaaatgagtgataataaatacagtgtgttgaatgctatgatggtagagtgggaaatgtttagggaatgtaaagcaagagatcctaagtcagtttgtagaggtcagggaagacttctggaaggaatgagacaaagtgtttggcaggtaataagtagggaaggaaaaagtaggcgaagtcccaaaaaggagaaaatacacatttgtaaaaactaaaacgagttcagtgaggccaaattctctgttatgagaatgtggttcctgatcctgtaggtgaacgttgccatctattgtagcctcttgaagattctccatgcgttttagctaagtagaggctctgacaagtcctcagttaaaaagaaatgttaatctagttttatcaagcatttatgaagtttgtataaacatgcaactcttttctgtcaacccaacctcctcttagcaacaggcagaactagtattccatggaacactagttgggaaactatgatctagacatttcagttgtgtccagtagaaagagactgtatttaagacagttcttgctgcccagtcaaatttgttccgggcctgaaaataaatatggagctttctgcccgaatgcttcttggcacactaggaaccagattaatcaacttgtgcagttggcaaagtgcttgatttccacttgcagcatttcccttgagggtctactcacagtctgaatgaacttcacttttcctgatgctatttgtccaacgcccagagacacaggaactcactttccctttccaattgtccaaatgtattagtccgatctcacgttgctaataaagacatacttaagacttggtaatttataaaggaaagaggtttaattgatgcacagttcagcatggctggggaggcctcaggaaacttacaatcatgggagaaggggaaacaaacatgtccttcttcacattgtggcagcaacgagaaatgcagactgaaggaggggggaaagccccttataaaaccatcagatctcgtgaggactcactatcacaagaacagcagtatgggggtaaccactcccatgattcaattacctcctactgggtccctcccatgacatgtggggattatgggaattgcaattcaaggtaagatttgggtgaggacacagtcaaaccatatcaccaagtgtctggaaattccctttgcactaagtctttcaaggccctctctgcagaagcacttttccttcggggagctgtgaggacattggctgtccttgccattctcttgatccacatattatgcttctcatgttttcatattggtgcatcttgtctacccagctgagcactggactttggagttactccgcttccaggtagtgattgtggacaagcaatttcacttctctgtacttcaattttctcatctataaactagaaattatattactgcacagggtccttgagactttagtgatttagatgatattatctcattttaaatgttctaaatgttccagatcattgagaacagtactgtcatctaatgagcattattaccttttcaagaaaagacggagtctgtagttgtcctggatttgatacaaaccttctccctacaattgctttgtgttgttgatattggctttgaatctttcataggacagtatgtttctctaggatatattcattcctgatctttttgaggttgtaatcccttcttccattgtttcttttcatattcctcctttttttattgataacagggttttttttttacatataagtcacccaatatacaattcacccatttaaattgcacaattcaacgactttcagtatattctcagggttatgcatttatcactacaatcaatttcagaacgtttttgtcaccacataaagaagccttatacccattagcagtcacttcatgttatggactgcatgttaatatcccccccaaatttatatgttgaaacccttaccctcaatgggatggtattaggaggtggggcctttgggtgctaattcggcttggatgaggtcatgagggtggagcccccaggatgggattattgttcttataagaaaagaagaggctgggagcagtggctcacacctgtaatcccagcactttgggaagccgaggtgggcagatgtcgaggtccggagattgagaccatcctggctaccacagtgaaaccccgtctctactaaaaatacaaaaaattagccgggtgtggtggcgcacgcctgtagaaccggctactcaggaggccgaggcaggagaatcgcttgaacccaggaggcggaggttgtagtgagccaagatcgagattgcatcactgcattccagcctgggagacacagcgatattccgtctccaaaaaaaaaaaaaaaaaaaaaagaaaaaaagaaaagaaaagaaaagaaggactacagcctgctctttctctgcatgcatgcaccaaggaaagccatatgaggacataaccaagcagaggccctcaccaagagaccaggcatgctggcgccttgatctctggcttccagctttcgaaactgtgataaatgaatgtttgccatttcaaccactcggtctatggtgtttctgtgatagcagtctgagctgactgagaaactccattgcctctcaacgtctctaccctcatttcccctaacccctggcaactgttagtcagtctctttgaatttgcctagactggacatttcatccaaatggaatcacacagtacgtgggcattgcgactggcttccttcacccacatggtgtttttgattgtcgtctgtgctgttcctgtgtgtcagtgctccattcctttttgtggctagagagtagtccattgtatggatggaccgcattttgtttatccattcatcagtggatggacatttgcattgcagatggaccttttggctgtaacaaatattgctgctatgaatattttaatacctgcttctaatttctttggttatatacctaggagtggaattgctggatcctgtggtaactttctgttcaacattttgaggaactgcaggatggtttgccacagcagctatcctattttgcatttccagcagcagtgccgcattgcttgacttatcattacctctacttgccagctcacttgtaaataggtaatagaccttctggcttattattgatatatatttattttaaaaacaaaggaaagggaaacttttgaaaaaaatttttagtggcacgtgtggaagtaattgtgctttatcaaaaaccaagaccaaaaccaaaacagatttggtggcgaggcagcaaatgttagcagttattattattagactaacctagattataaacccctttgcagccaaggactaaaccttatttacctaggttttattcagggagcttgtcaagaggcttggggtgaatacacatttatcattcttccatttgttcacttaacactttatgcagggttatggtgtatgcctgtttttagtaatgtgcaattaaaaaagagaaagacaagtttaatgccacagcaagtctaccattctactcagtgaagttggactcacaggcaatagatgcacttaagcctgaaacagtgaatggaggcttaaaaccaatggaaattacttatgaataattttaagggcttgtcaccctttgacaaaagagggagatacatgattcatctggccggctaagtgggtggtgatggcattgttggcaaagaaatgcaggaattaactgaggatcaagagaagctttgagcaagggggcaagaggggggaacttataggcttgtcctcagaagacatttgtggtcgatttggggattttaaagatcaagttagactcttggtcatttttgctctttacctgctgacagccttgcgaaccattcaaggaagtgctggaacatggcagaaagcacagaagataaaatctttgccttctgggcacagggtctggtgtggaaggcaacaaaatcaaatagcaatcacaaaaccatacaaaaaagacagagataggagtgtgtgcagagttggggtagcacagaacagggagcttctgaaggtaaggtcgagtgtattagtctcccagaactgtagtaacaaattcccacacacttgctggcttaaaacaacagaaatttattctctcacagttctggaggccagaagtctgaagtcaaggtgtcagtagggccatgcttcctccaaaggctctgggggaagacccttccttttctcttccagcttctggtggttcctggcatcattccttgacttgtggctgcatcactttagtctcatggctcctttcctccttctccctgtgccgctcctctgtgtgtctcttacaagggcacttgccattgaatttagggcccactcagattaggatgatcatatctcaagatctttaacttaactacatttgcaagcctgcctgcctgcctgcctgcctgcctgccttccttccttcctccctgactgccttccttccttccttctttccttccttccttccttcctaccttcctaccttccttccttctttccttccttccttctttccttccttccttctttccttccttccttcctgcctgcctgcctgcctgccttctttccttccttccctccttccttccttccttccttccttccttccttccttccttccttccttccttccttccttccttcgttccttgacagggtctcacactgtcacccaggctggagtgcagtggcgtgatctcagctcactgcaacatctgccaccgaggctcaagcaatcctcttacctcagcctccggagtagctgagaccacagacatgtgccaccatgcctggctaacttttctgtatttttgtggagctggggtttcaccattgatgtggtttggttgtgttcccacccaaatctcatcttgaattgtacctcccataattacaacatgttgtgggagggactggtgggagataatttaatcatgacggtggtttcctccatactgttctcttggtagtgaataagcctcatgagaagccgtggttttacatggggaaaccccttttgcttggctctcacttctctcttgtctgccaccatgtgagatgtgccttttgccttctgccatgattgtaagtcctctccagccacatggaactgtaaatccattaaacctctttttctttataaatgacctagtctcaggtatgtctttatcagcagcatgaaaatggactaatacaaccatgtttcccaggctggtcttgaactcctgggctcaagtgatccacccacctcggcctcccaaagtgggtggattataggtatgatctatcacaccaggccctacaggccctttttattttcacattaacaggttctggggtttaggatgtagacgtatctttttagagaccaccatttaaccccattacattagggaagtctccttggatgcaataaacagtttgtctaaatcctgaagcaattagctaggtgaaagggtagaggaaattattccaaaaggagggaggagcatgtgcaaaggtcctgttgaaagagactctgcagccattcatgcataccatgagacttctggagtacagggggagtgtgtgtagcatatcgtggagtgaggaaagggagatgttttgggctagggaggtatgcaaggcccatattccagacagcctgggatgacatgataaagagattggagaaactactaaagaattttaaacagggaggcaatatgagccaattggcatttagaaagatcactttggacaatttgtggaggatggggtgcagcaagtccagtggtggcgaagctagttagcaaaacttttgctcagtaaatgtgcattggcttgaatcctccctctccttatttcacagattctattttcttacattagcgtgtgatttttgctgggctgttggatgctatttaacatgctaagccaatctacttacttgtaatgctcatcactaataggaaacaagatgctggcctcacaaggtaaactggcctcactcagttgacaaagtcccttgcactgatgatcaaagattgtaaatggattaaacaggttgacggtgtcagttccaattttttgagctaccaaatcatcttgtcaacaattagcatctacaaaatatgaagacggatacatcactgtttcagaaaagactgaggaattctgggtgttgctctggatatgacacagatttctcccttaccactgctttgtagtggctgctgaaattaaggcttgaatgctttaagaatacctattgaacctcctctaggtgtcaaggatatccaggatttagcagagaaccaaacagcctgtgccttcgaagagctcacagtctagaaaggggtggtggtacttctgtgctagagaagagaggggggttctgtatatttcctaaatgccccaccagaggggctaaagggggaaggttgcagagtcctctgttttggcttcatgctgcagtgcctgactctgccttgaaggtgtcttgttcagtggtgggatcactctgcttgttggtgacaacctgggtatagagatgccttctgagtacattccttagatgtcctccctgtgctcccactcccctgtccactctttgggggttagcatcatcactgtccatgccctccaatgggattagctcccttcctgaccccagggatctcttacagcatggaagtgcatttctccaggtccatttattcatctgttcatcctgcaaacatgtactggccgctgactgcttataatgtccggtgccagcgcttgggattaatatagacacaaattagacatgagtcttgcctttaagatgcttaacattcatgtcacccacttaaagcaagggtggactgtgggagggctagtgataagcagggtgagatttcactggcaagaggcactgatgccattggaaggggctgggtttgtgggtgtgagagtggtgggaaatgtagggcaggaagagaaaatggtgaagctgccctttgaagggtttgactaggtgaggatgggtcagattcaccctgacacacctggccagggctgatcctagtctggaattagatgtctgggttcagaacccatgctatctgtgagaccatgtgcaaaggtcctcaccagctaggccccattacctcatctgtgaaatgagatacacatagttcttccttcctggtgattccctggagatttggccagcttcgtatgatgctttgggcacaacccccagcatggcatcaactcttgatcagtaccagctagctgccattgctgttagccaatccggggagagaagggacttttctgacactgcgagcttggaacaggcgtctagtaccatatatttaggagactggaagggaaaacttgaccatttctttgagttgtaaacttgcctggtagcaaggaggagaaaaaggtgagcaagtcccatgtctaaaaccctattaaaggctctttattttttcctggctctagggctgcgttttctacctgttgttatgaaaacatggcctaaaatatctctagccaagcagtccagagcccatgggaactgtcaaaactgggattggagcataaatatgaaatgacacgaagcttcatgttctgttattaaacttcacagctagaatttttgaaagcaaattatcttgtagaaatattcttgttacgttaaactggaaatgaaaataacttatttatttgcttagatcaaattgttgcatgcaaagttaggctgtgttgtttttccactgccaaatgctttgacgcattcctttaaccaaacagtttaaatgtgaatattagttaagatgcatcaaccacagtgggttgtcagcctcctaaggattgtatcctttcaaatgggtcaatgaatagagatttaaaatagaagtcagatactttaatgtttttcgcattcaaccaagagaacaatttgcttgcagatagtaggggtatgttatatgtgattgataaatgagcttatttacggcaatttgggcatcccctgtatgtgccgtagttttcagaagcacgagcaggtgttatcagggcttgggatgcaccttcatggccaccagatgtcactgttgagtcacagaagcacagccataggggctgagaatctttggtggggaggacgtttaggaaaactttaccttgccaaacagctcattctttattttaaatatctgccaagcccaggatcccagggcaagcttagctgaagtcaggagagtgctttagagtatggaacaaaattagggaaataggaaaaaaatgcagtatttgctctttctgtcttttggagattctccttgtcgctcaatcacacttgtacgcctgctctctccccattcccagcccagagctaagcagtaaatgcactgaattggttagacccttgcaaaatcgcagaacaccagagctggcagggctcacaggcgtcagctagcacaatgtctcaactcaagtgcaggggcgccaataggaggaggagttgttcaaagtctctgttagctttaggctgaggatctctcataaggatattaaataaaggtatagcacagcggttcttaaaagtgtggtccctggaccagcagaactagtatcacacgggaacttgttagaaatgcacattcttggcctgcaccccagatctactgaatcagaaaggctgggttggggtttagcaatctgtcctttaacaagccctccagaggattctgatttgacagagggaaaagctctactgataatacgggtaggagagcttcagttcctacttccgggtgccatcagcatctctccaggctctgggctctgaagattatggttaattcacagcttctcattggagcttgacctcatctacacattccctgggaaaagtgtctcccttctagacatgactatattgggttgaggtatcaagatacttctcttctatgctccccattttttcccggctccaccttccagccatggaatacagttgacttaggatgctccctggtagctcccttttgggcaggagcagctggagccctagtcaaccctttcccctcctctgctcccttatcccccttatacttcttcccctgtgtctcgcacttttctatttcaggagggagagcttagtgctattgagaatctaccacgtgccatgtgtttccacatgttcttggagctctcacaacaaaccatggaaaagagagtttgaccgtcgccactttttttttttttttttttttttttttccaggccgggaaacggccaaggtcgcactggcaaggacttgtgtgcacagggaaatttcaatggtcctccttcaagttaatggggctttactttcctcccaggctctctctgcatttttaatgagactgcaagtcccaagagggaagccaagtaagcatttcagattcctctgcctggatctgagggcagagacttctagggggttgggaggtagaagaagggaatccctgtgattccccacaaggtgcgttcccaagaaagagtgcctcttctgtgcttggaaaatggttagatcctgagcgtggtctcccacagaaagaagtattccttagctttcgacatcacttatgttgtcattttccagctacttttaggactgcccatttcctatattatgtgttcttctaaggtttaacctcaagttagtgtaatcaaagatttttttctgctacatcaggttagattggctttgcaaattctggcatcctcctgtttcctcttgtttgaatatatgttaaaaaaaaaaccataaaaacaacaaaacaaaataacaaaaaaaaactatttatcttattttggtactctagtttttaggaaaggcctgatcctaatcatgtttggatgcacactaggaaaatactacttaacctttttcttgcctttttaatgtctgctgttccttttcttgtagcaagtgatacagaggaattgcagtgaagttaccatgaagataaaggtaaacccacacaaatgacctccagcatcttctgtctttagcttttccttcctagccgacacatcttttgagttttagaacatttacgttgttttatactccatctcattttgaggctttcctctttctttccaggctagttctttgtgatataagacttaattctgcttttttgtttctgattgagaatttcatttccttttatgcttaggcgtttgctcagcctaacttaccagtgtggtttattctgctgagaaaaactgagaactcatgagaatgctgttcttctttccttttctttctcagtattcaagcgtgggcttgggagtcaggcattcctgggttcagatcttggcttttcttcttactaggttgtgtaaacttagatgagtaacttcatctctgtcagtctcagacaaactgagccaggctcagacatgcagattcagatcactgggccaccaggtcctagtgatgccccagagaggctgctgggctttgttgtgggtgacctaaagaggtgcaaacccaaaagtatctgagacaggtctcaatccacttagaatgtttattttgccaagattaaggacacacccatgacacggcctcaggaggtcctgctgacatgtggccaaggtggtcaggacacagcttggttttatacattttatggagacgtgagacatcaatcaagtacatttaagatatacattggttcgatctagaagggtgggacaccttgaagtggaggtggaggagagggttccaggttataggtagattttaaaatttccagattgacaattggttggaagagttattatcaatagaaaaggaatatctgggttacataagaggttgtggagagcaaagttttctcatgtacatgaagcctccaggtagcaggcttcagagagaacagattgtaaatgtttcttatcagacttaaggtctatgttgatgttaaataatggtcggtttttcctgaattccaaaagggaggagggcatcatgaggcctgccccatccccactacccccacttgccgtcattgcctggaccagtttttcaggttaactttggagcaccctggcctagaggagggtgtcaattcagatggttgaggggggcttagaattttatttttggtttacagagggtgggctcggcccttctccaggaagctggcatctgagaggttgagggccatggccctagggtgcatttgaagggatggtaaccatgtgcagaaacactgcctctttagtgtcagattcttcctggacctagccattttcttcctttctagttctccatcatggatcccattaagtccccatcctccccagccccctctctatctatttctccccccagcagttgcttaaatgtggtaccctgatgggcaggaaagcaattgattagacttgaggtgacttgagttgtgttcagcaaaaatcctcactcttttgactgacttcaagtggcgtcatgacaaaatcaacctgaaaagacataattaataccctatacccttttattccaagttcctttcggttggaaagtactgccagctaaaatcattgtggtgagtcttgcctttcttctcaccagcctgtacatttgaatggagttagggactgtagcgtgtttatctctctattattccccattctgagtatagtgatagatgctcagtaaatattgattgattggctgattaatggaaagacttgggctctagactcagcttatatgatcttggacaagtcacttaacttcctctgagtccatttttccatttgtaagaggttgataattaattacacctgagtcttaggtcacactctccaggagtagctattacatgtggcttcaggtttgagtggcttattaaggaagtggtggaatgggggtagtaaggaaaggggaggaagcagagcaagggtgtgatctcaggaaaagtcctgcaggggccagctccagccttccagcgtgatcccacaggggaactctggaggcagctctagagttgttttcttctccttctccttctccttctccttcttctccttctccttcttctccttctccttcttctccttctccttctccctctccctctccctcctcttcgtcttcttcttcctcttcctcctcttcctcttcttcttcctcttcctcttcttcctcttcctcttattcttcctcttcctcctcttcctcttcttcttcctcttcctcttcttcttactcttcttcttcctcttcctcctcttcctcttcttcttcctcttcctcctcttcttcttcttcttcttcctcttcctcctcttcctcttcttcctcctcttcctcctcttcttttttgtttagagatagcatcttgctctgttgctcaggctggagtgcagtgacatgatcacagttcactgcaacctcaaactcctgggctcaaaggattctcctgcctcagcctcctgagtagttaggactacaggtgtgtgccatcacactggctaattttttaaaaaattttttatggagatggagtcttgttatgttgccaaggctagttttcaactcctgtcctcaagtgattctctggcccctgcctaccaaaatgctgggattacaggcatgagccaccaatgtctggccaacctttcatgctcctgcatttcagtcactggctaggactgagggcaggataagggaatgtaaattcccagaaacttctagtgctatacccatttgggcaaagtgttctctaatagcccaagggaagttctccaaaatagagctgcagtttggaaatgaaagcacaccaaagtctgagtgtaaaagtaaaaaaggaattgggtgggacactgacattatcctcaacatcctactcatctacatttctgaagagttactggaatcagacaagaaatacgtggaaacacttgtaaactgtcatgttccattccaaagtaaatggtggcttttttttttgttatttgtttattttttgagacagggtctcactcctattacccaggctggagtgcacaggtgtgatcacagcttattgcagcctcgacttccggggctcagatgattctcccacttcagtctctggagtagctgggactacaggcacatgcccatcacacccggctatttttttttttatacttttactaaagatgggatcttgctatgttgtccaggctggtttcaaagtcctgggctcaagcaaccctcctgcctcagcctcccaaattgctggaattataggcatgagccaccacacccagccaaatggtggtttttatattcaataaattgttttctaaaaaaagtcttgtgcatctagaaagactcaaaaaaaaagagaagaatgttcatgttaatcatacattctggttcatacagagtcaccctttgataaaatttcatgtcttttgagtagtggtaatccagtaccagttttcaaagaattctaatttaaattaacgctgtaactacaggcaagacaatttaatctctgtttgatgcttcagaaggcatttctcaatcttgtagggcctgagggtcatgattaccattgcactgtcaacatgcagaactgcagttaacagactgggttactggaatggggaaaatggcatctatctctattttgttatgagagaggtgttggctgttgctgtatttgcaaatggctaagcattggagtgctgacaatttttcaggctcaaagctttgattttcctttaattatttggctgaagtggaagacagggactcttacctgatttaattagataatctcaactataaagacatgggttctgtgacatggttaaatagaattttgcttggcagtttttcacagcatcccaaacaaaagccttgaggtagccatacctcaacatacacactgcctcttgtatcacacaatgattatattttgattgccatttgagttgtcatttgacatcatatagggagcaatacattttccttggactaggatggccaaggtaatttctctcctatgaacttatccatttccaactctggcatggtcattcaaaatagtatctctctcccaccaccactcactttgaactcattattgatgcattttgacatcctgccacatctcctgtattttgataggcatatatggggattcaggaaaactataagatctccaaagctgggaaaattatgaaggggagaagtcttacctggaaccatttaataatggaaggcagaaaactgacaaggagagtgaagatccaatcttgggctcatttatggtttcatgaagaccagggacactacagcagaaccttcttaataattcttgaggttttgtaattgccccatctgtgttgtgttcattattttctgtccttttcctttcgttatcatcagggctgacagtgaaagcaatgcattcattcaattattcatgtaacatttgtcacacactttctgtgggccaggaatgtgttgggtctgaggccacaaaagtaactcagacatggccccatcttcaaggctctggcacagtctgagttgagaggaagagatgaatatattcatacccaagaacaataggccttacacatcagaaggaagagccaagggccataagaaaacagagcaggagggcagaatgaaagagagtgagggattattttgttatagagcaatcctggtgagcacagacctcagcacggagaaaggaagagcaactgggaggaagaggcagagactgctgactcttaaaggcatctggaaatgtcccaaggacagaaacataggtcttgctattgcccgtgaaagaagaaatgctcttgcagaaagccctggtgttatcgtggaatttaaagaggtagtgccattctaatgagaggctgaatatacaagcagaaagtgacaatcgccagacttatagagaagtagaactctgacccacaacctctgcagcaattggccccaaacacccaggatttgatcaattattgccagttttcccaagttggtccttgtttccaacttaagacaaaccagagaaagtcaaatttgcccctctagacaactgcatgggatgctcctcttccacccttctagctcacctatccttccctgtgtcaacagcctccaaacagggcacacttgaagccttcccttttcccaacatgaagcgttccctctcctttgcctgccctggaatctgccaaatgcaagtgatggtggctgattcccttgcagtcgcaagctctgaatcaatagcctctgcttgttctctgtattagttcgttttcacgccgctgataaagacatacccgaaactgggtaatttataaagaaaaagaggtttagttgactcacagttccacatggctggagaggccctcacaatcatggtggaggtgaaaggcacttcttacatggtggtggcaagagagaaaatgacaaccaatttaaaggggtttcccctgataaaatcatcagatcctgtgagacttattcaccaccatgagagcagtacgggggaaactgcccccacgattcagtaatctcccaacaagacatgggaattatgggagccacaattcaagatgagatttggatgcggacacagccaaaattatcattctcctttcagtcctttttgattatttccagtttttgataagggatattttgaagcatgaactcaagagctaacacacgccaaccactcagtaaatgctattcttttctgtggagcacccgctacattccctacaacatgcctggggagtgccctcttctctcccaagttaccaaccaccctggcataaggtggactggacctttataaaatcttacactcatgccagggaagggtacctgagtggtccaaagagtttgatgggtagcagaggccggggcacgaacacactccagtcccaagccagcaactcaaggacgcctttgaaagctgtgcagagacggagtggaaaagatgcctttcaaaggaagaaatcttgttccaaggcaacagtgtttctatcccctccaagtgtgcttcataataataaagttcctgataagctgtgtgcaaatcgcacttctgtaaattgggtcctacttcccccatgatttacactttcctttaagtgctgatttatcatcatttcttcccttggcaaccatccttatgacttgcctcttagttctagcctccctggcagataattaatgagctcttaatacagcttatgggcaccagagggaacacacactatttaaagatgtctttcaggggatttttttttgtgtgtgtaaagtgaagaatcccattgtcatgaaaaaaaaatcacatacatttggcaaatgttgcccttttgaacttgtggactattcaaaggcagatgaagaagtttgcttacatcattattcatcaatatacattggtgtagggtttaggtacccagtggttcttgaaagtactgggggtggaaaactgtgttattaaaacttttgattaattaattgcttttcttgtttgctcacttgttcaacaaatacttactgaatacttattatgtgccaggccccatggaaatataatattaaactggatagacatggtcatcctcatggcatcacagctttttggggagacaggtaatgagcatgtaattatgcagataacgagttcactacacatttgataaatgctaacaagggatcaacgaggggggctaatgaggcctgagctaggtatggggagggaaagtggtcaggaaagctgagctccaaggttgagttagaagttaccagggaaagggcacttcaggaagggaacagaatgtgcaaagttaccaagaacaggaatagctcagctcttttgagaagtgggagaaagacactgggtggaagataagccagtgagattaatgggggcaccatggccgtagcgcctatatgctaagtgttttgaattgtatcctaagaacaatgaatacattattgatgcattctaggcagggaagtgacgtgctcagatacaccctgtagagagagaatattgtctgcattgtggtaaggaagggataggggaacctgttgggacccatagcttttgtccaggataaaagaggtggtattcagtagtgattttcatcagtgatatcctccaggagaaatgggttgagggtgttaggattcaacttagtccatttcacagaagaggaagaagaggtctagtaggataagaagagttataggactgtctcttagtggaagaggggccccctcctgacaatgcagcatcttcactgtggccctgagcttcacaccagggaaggactgacttccccaagaagggcacacatgcaggcaatagcccgccagcctgctttgaagttcctccagcaggctttggagaaagagctttcttcttgagttctgacttggaaatagggatcagaaatgacggtctctgcaagtgggtttgatatggagaaacttctggacacaggccccagtcttcagtggagtgtctaagtatctcaggtccccaaaactggtcttgatggcccctccatcagacaccagccaggagttgacaaatgtcaatgggcaaaggtgtccctgggggagaagcttcttcagaaagcagattcctgggccctgctctcagggattctgtttcaggatctttggctcatggcctgggaatctgaattgcataacaggccctatacccctcattcattttgtctccttgtttctaatatggatggtctttaaatcatttaaaaactctgggaactgttgctctagtgatttaggcctctaggagactggcttgcctgagctcagcaaaacataatacctggttctgggcaatcactaccagttaggaagctcaggagtctgggtgggatcttgaattggggaacagctttgggccaagacttaacccccttgcttccccatattgccagagaatcatccagagcatttataaacatgtccatttttctccagagattctgattctgttgtggtttttagcaagcgccccaggtgattcttaggattaggtaggttgggggcctttgccctagaggcttcaggcagcttttgcccttaaggggccatacggggcctcagggatcctgggtgtcctcagaggactgcagggagctctgggagtgttctctaatgtgctctccaactctccatatctgctctgggtcttggattcttcatcagggcatctggggacagtccttcatgtaggtggcaataatctctgctggggatcgttcttgagcttcttaggacgagaattctgttagattctggatggggcctgatgtgtctgcccagctttgcggccaggccaagggaaaaacctgtggaggcaggatacccagctgaaatgcatcactcactgccaaaggtgaacccgacgctagcttcagcaaacctgggtggtgaatggttttaaaactttgctaaaaccagaagagctgtgtccactcagcatcaggtgaaactggccaaatcggggcaggtggatgggcttcctggggacaagggagaaaactccatcttatttctgagctcctgaaaagcaagggcaagggaggtcttgagtcagacttgctctagaggcgtctatgagtttgctccccacttcccaggctcaccttcggtggtcaaagagggcccctggaactgtgtgggaaaggtttgcggaactagaaatctcctcaagttcaaaggagttgcagtttgtatgtgaagtttaaattacactcgaaggcagtggctgcaggtaaaaaaacgaaaatgaaaacccaatgaaaacataaaaagattttaaaaaatgcctgcttgtcccactggctcagaatcttcgttgcgggcagggagtggggagctggtctaaatatgtttaaaagctccccgttgagtgtcacgtgcaggctctagggggtctgtgagcgtggacgttgagcacacctgtggttccaggggggatggaggccatcttggatgcctgggtgttgggggtttcagttcaaagaaggcaggtacagtattctgggactcagggatgggcaaacaagcttaaataggatggggcttggacctgtgggttttgattatggccagaactggcactggtcatccactccatctgccatgccaggcacacagctgtggagccattggcagacctgctccttggagaagaggacgatggccatgtcttggcattgatgtgccacaggattcctgtcaaggactttttttagggaaggcctctgtctttagctggtctccttgactttctgcagcctctgatctagcctttggtggggagtttggagttcacaggatcactgggccaaggaggttgcagctcccaatgctgctggagtttcttagctggggagagcattcttacattcttgagggtcctgccaatagggtaggtggagagctgctttgtggctctaggaggaagtaaagtgacagatccctgctggctcaagaaaggtaggccgggcgtggtggctcacgcctgtaatcccagcactttggaagactgaggtgggtggatcacctgaggtcaggagtttgagagcagcctggagaacatggtgaaaccccgtctctactaaaaatacaaaaattatccgggcatagtggcacatgccagtagctggtgtagtaattccagctacttgggaggctgaggtaggagaattgcttgagcctgggagacagaggttgcagtgagccgagatcatgccactgcactccagcctggccgacggagtgagactctgtctcaaaaaaaaaagaaagaaatgtgtcctgagctcaagtgtgagcaccagtcaggagataacaatggaccaagagaggaggggcatggcagtgttgggaagggctggagggcagtagaggggaagagggcagatgtgtacagcatttgggtgctgggagaagtgaacctgtctgcttctgggattgactctttttatgattgctgcagcagtgggaaggggatgttgaccagtgatttgggggtccattgggtgctgggagaagtgaatctgtctgcttctgggattgactgtttttatgattgctgcagcagtgggaaggggatgttgaccagtgatttgggggtccattgggtgctgggagaagtgaatctgtctgcttctgggattgactgtttttatgattgctgcagcagtgggaaggggatgttgaccagtgatttgggggtccattgggtgctgggagaagtgaatctgtctgcttctgggattgactgtttttatgattgctgcagcagtgggaagaggatgttgaccagtgatttgggggtccattgggtgctgggagaagtgaacctgtctgcttctgggattgactgtttttatgattgctgcagcagtgggaaggggatgttgaccagtgatttgggggtccattgggtgctgggagaagtgaatctgtctgcttctgggattgactgtttttatgattgctgcagcagtgggaagaggatgttgaccagtgatttgggggtccgttgggtgctgggagaagtgaacctgtctgcttctgggattgactgtttttatgattgctgcagcagtgggaaggggatgttgaccagtgatttgggggtccattgggtgctgggagaagtgaatctgtctgcttctgggattgactgtttttatgattgctgcagcagtgggaaggggatgttgaccagtgatttgggggtccgttgggtgctgggagaagtgaatctgtctgcttctgggattgactgtttttatgattgctgcagcagtgggaagaggatgttgaccagtgatttgggggtccattgggtgctgggagaagtgaacctgtctgcttctgggattgactgtttttatgattgctgcagcagtgggaaggggatgttgaccagtgatttgggggtccactttgctgcaaagacagatggagctttgggctcagtcccaggttttgctagaacagaggtttaggactaggtgggagattgaagaatcttgaatcctttatctatctggatctggtggctgtcttgggccccagagttagagttgaacaaaatatctttgttcattagacaaacatttattaggtacttacaaagtgcccagcattgtttttggtgctggagattgatcagtgaataagcagacaagaatctgctctcatgacaaacagataatactcataaaccaatcaggtaaacaagtataaggactgtgaagaaatacaggaccgggcagtgggatagggtgtgcttggggaagggctattttagaatttgtggtcagaggaggcctttctgagaaggggactttggagtcctgaaggtgaataggagccagccctgggaatatctgggggaaacatttccaggcagaaggagcagtcagtctgaagatcctcaggcaggcatgggtttggtgcatttgggaacagaaagatcactggtgtggctagggtgaaccgatcaggggcgtgaggatggaggatgtcacgagtaagaggggaaggcaagaccagactctattgggcctggcgggcctgagtaaagagtttgaattttactcgagtgtaataggatgtcattggagggttttccataggaaaatgacacgatctgagttacgtgtttaaagcatcactttgaccactgtattagtttcctggggttgccggaacaaaaaatactttaatccacacattgactaggtggctgaaacaatagcaattatttttccacagttctggaggtcagaagtctaaaatcaaaaggtcagcagagttggttccttctggagcctctgagggagaagctgttttatgcctctcttctcgtttctggcagttgttggaaattcttagcatctcctgggttgtagttgtaccactctagtctctgacttcatcttcacatggccttttcctctttgtgccttgccccttctcttgtgagctcacttatgaccagatttagggcccactctaattaaggatattatctcgaggttcttaattatgtctgccaagatattttttcgaaacacggtcacattcacaagtttcaggtggacgtatctcttaggaggtcaacattcagctctactatcactactatgtagaacatggatttagggtaaaactggaagcaagaaaacagcttaagccagaggccccagaaactgggactgggaagttgctggagcaggtgtgaataccagctccaccttttagtagccaggggaccttaagtcacctccatgaaggtgctgctgagtcttgattctttctttggataaataggaataataataattcctaccatataggatggcaggaagattaaatgaattcatacatggtgattagcatcatctcaggccacaggaatggctcaggaaaatgttattggcttttgatattgttaaatgttaacaggacagtcagcctggtaaagtgatcttgtgactaggagctgggtggttttgatgtgaattgtgggagcaatgagatcagattttggccattttgggtttgatctgctggctgtgtgggcagtggtagtggcaggggttcctgggcaggaaggatgctaacagagaagagaaccagtaatggattaatacacacacacatacacacacacacacacacacacacacacacatacacacacacacatacacatacacacacacacacattcatgttgtggaggctggtaagtctaaaatccacagggcaggccctcaggctgtgtactctccagcgggagatgattttgcagtccacagatgggatttcttcttcctctgggaaacctcaattttgttcttaaggcctttcaaccaattggatgaagttcaccaagattatcaagaataatctcttttacttaaagtcaactggttgcagatcttaaccaagtcttcatatcaccttcccatcaacatctggactagtgttcaattgaataactgggtcctatagcctgaccaagttaacacataaaactatcacaagcggtaaccctgcaatgaagtccatatcctggggtgaggctggtgctttgagggagagtgggccagaaggaatgcagacaaatgatgggcagagccttagcagacactctgggtgttcctgaaagaagtggagcttccggtaagtgggtgggagccccgggaatagaccatagggtgagtggaaggccatcagctggccagcttaggtggcagagtaggcagtgagggtagtggatatttgtggcactcttctcattcctaggagacccatcctggagaaactggaatgttatggcaggagttggacctgggaccaagactggagatgcctcttgatgatatctgggccttggaagaaggaaagagtccaggctgggaagcaggcaggctttggcaatggtgatttcagaatccttcctcaatattcataattgtaaggctaggttagtgttggtgtagcttcctactgtccagagttgcaaagtccagtcttgaccaatgtcctgtagagtgattttaataaagaccaaaagggaaaatgttgacaagtcatctgatatttgcttgtagagctttctgaaaagccacgataccaaaaggccctataagcagcagaagaaaatgacaaaggattaaaaaaaaattccacttatcctccaactcaaaagaataggccccagcttaaagaattatgatggctgttgggtattggagacctattatgtgtcaggatagtgctgaacagtttgcttccattttctcatttaatattcacaacaaccctgtgacatgggtatgacaatctttcccattcatacaaagaaaaattaagtcctgagaggctagcaaacttacccaagaccatgcagttcctatgtggcagagctaggagctattgggagccaaagccatgtcagtctgactctagagcctgtgctcttcaccatgtcacccatccaaaacccagaagagtcagcactttgagaaacatactgaagccaactaaaaggggctcttcacttgcatttcgggaaaaaagtggatgaacagaggactgcttgcgtgaagttttaacagttgagagagaaagcagcgctgcttaattgctggttgttttttttttttttttttttttttttttgagccagagtctcactgtcactcaggctggagtgcaatggtgcaacttcagcttactgtggcctctacctcccaggcttaagcgattctgctgcctcggcccctgagtagctgagcccaccaccatgcctagctaatttttgtatttttagtagagatggggtttcaccatgttgaccaggctggtcttgaactcagacctcaagtgatccacccgccttagcctcccaaagtgctgggattacaggcatgagccaccatgcctggccttgattgctgtttaaattctgatttttctaatgatcttcctgtggggaaaaatagagaaaaggggagggaatctgggtccatcataggtgtgaaggcaggaggccatcaccagttcatagaaacaagcttgggtctccagaattagatgaaatttgtcttgcgggtctgttggaaattttaaacgtaaaatctatagtgctggttgctatacaggatacagagaggctacttttgaaccttctccttcccttctgtctcatatccgctccttctcaagaaatttatgacaatcaggaaggcagatttttttttccttttccaaatctattcctttggcacaggaagaatatgtcaaacatgaagagtagatatcacatatgtggcaaatttataataagcttagcattgaaatgtcccctttcctccctcttctctttgtccttcttatatttgagaactgttaataccaccaacgcaatggtgcataccaaaaataatgctgtgtaactaacaagaacaaataagcttctgttgcttgtgtgtcctgagtcaagtgtgggcagtccagtggctctgctgatcttggctaggctcactcacaggtcaggggtcgagtgggcatcgttcatttacagtctggcttatgcaaggggaaaccaagacaacatggctgttctcatcctagaagaggatgattgctttttcatcctagcttgctagtccaggcatattctcatagcagaggcagaggtgcaggaggataagcagaaagaacaagaatgtgaagctggtattcatatccagcacatagcacttccacagaattctgttggccaaagcaagtcacaagttcagcacagacaagaggtagggaggtaggctccacctctgtaataagaggaactgaaagtcacatggggccaactgcacaaaggggtcatgaatgtagctgatcttccataagtacctgctgtgttccaagcattgctttgggattgtgacgatacatagtcatgtctctgcacttgagggttttctagtttggtgaggccatttggtgagtccatttgctgggcttgaatatgaagttttggttaatgcatgaatttctggcatgttattgctttatactggacatacccttcttcccatgtgctgctcagttttatctctgtggctggctgtagcaaacagttttccaaagtagagagcaaaaaccctctgagacttctcccagtaaatattacagctcagcaactgccagccatttgtctcattatttttcttagaactgccagagcagagaggaattccttggtatatctgagtggagttgcagaggtgagagagtcgtaggaagaattccagcaacatgcagccaaagtcactaactcagatctatttcccccagagatagacctggtgaagcacaacaggagattctcccatgttgtgtttgcttgattctcccatgttatgggagaatttcatgggagattctcatgttatgcttgcttgattgaaatgctattgttggcaatggtcattggaattctctaagaatagcaaccctgtctgcttactcctctctatttgccaaatgcctaacacagagccacatggttaggcattctttaaatatttatttgttgaatagaaaaaggagaggtgactgaagactgataatagacagattttgaactttcccaaagagaaggaaggttcttttagaagttatcggccagtgaatttgacactagtgaacggtgcagtcccagactcaattatcaaacagatggcttgtgaggcagtggaaatgggagctgggattactgggagccagaatgggttcaccaagaactggtcgtgtcaaaccaaatttaattcttatgtgatcagattcttgtactcttataacagcctggaggcaggatgtgcatgatatccagcagggcatctgacagcatctttcataaaacccccatagttggcaggtggaaatgtgggcccagttagttagcaggttgatttataactgggtatttaactatatatgaagatcttctactaatgtcatttttttttttctggaggaaggaagggagttttctctacctgtatattgtgggaccatcttctccttatcttgcctgtatttaccaatagttataatacagatatatcagttaagcctgttaaatttttaaatgattcagagttgaaaggaagaaacttaaatgttggatgatggagtcatgattccgcatcatgttgacagaccaagatgatgggtggggctaaaagatgaattttcataggaataaattcatagcagagactagacattgaagagtaatttgcaagggtatgggatagcagagccccagtttaagagcacacagtcaattagtggataagaagtcatatacataaagggaatgaatagaagtattatgtgaagatcaagggagaatatagtccccctgtctcctgaatttatcagatcacactattcaataaaacatttattaagtacctctctgtatcaaagtcttagccaggcactttccttgttaaataaattagtgtgagttccaaggaattcctccctctcagttgctacacaaaacatatcaaaaagcccctggtttagagctgggcactcagcaggtgctatataaatgccaagatcacactatgacccacagctttatttatagcctgtggggtcaacttccctttcactctttcaccatttctaacctcaaacctcttattacaagtgagtggatttgttttgaatttcttcatttattaaacagcattcttttaatggctcatttgatagcatgagggctctgtgtgtctattcctgtttatcctttcatctctttctttggatggtggttccattctctcgtactacagacaactttccccatatttttgcaggaaatgaccagaagtagctcaagatgatattatcctttttggtgttcatatatcagaggaagctctgatgggcctgacttaggtcataggtcatatggtcactcttggactggccacttctgggtattggtgttcactactatggtggcagtgtgtgtgtgtgtgtgtgtatgtgtgtgtgtgtgtgcatgtgtgttgggcaggggctgtctgtgaatagcaagtttagccccatgtaaaccacatggaataatttcccacagagaagaaaagggttttataagcaaagtattgcgtaaagtacactagagaagcatgtaatagatatttataaactccctttttcctgaagaaatggctagagtatagggaggaagagggagaagaaagatggctgtggggccccttcatctcccagtacattaaccagctcctgaattaagggaggagaagtggttgtgatcccttttgatcaatcattattttaaaatcaaagcagaggactgctttggtttcaggctgagatatgctgctgccttttctccccattggagtttggggtttgtgctttctgcttatcttttcctattgcttgaatgtatgaaggaatgtcctggggaagcttggagtcctcaggtgaaaaggcttaatgaggaacacagtgactgtgccctgacaatttgtgagggagtttctgtatctgtcctgcggatggtccagagagagttaggaaaagacacactcattttcacctcacctctatttctgtctctgttggctgaggctgctcatttctgaggctcccatggatctgggaaatgggaacctccagtctctcttcccctctgctgatcaagcagccggaggacctgtcatgatggttacatactccctgtgaacagagggacaggataaattcctggttctagagaatctgatgctcagactaatttgcacactgggatcccggaggcccttccatactatcacatattctgcctcttgattacctgggctgacaagggaacgctggcatgggcacccaactaggtcattaatcttgatgtcacctgttcggctgtggacttcactctgggactcaagagttgttttccagaagattttcagctctaattatgtttaatgggacttgtattagaagaggtaagttctgtgaatgctgtcaagccagctggactatggtcagaatttattctgatatcagaaaattggccttcagtgaaaaggtcaccacagattacacacaaaataagcgagtcacaggtggtttggagcagttatttatactcaagcttaggtccacaaatcccgtcttttaatttatttttttcctgcctccttgaaaaactttacatcatttgcctttccatttatctatgaaatgttaggagtggaaataaacaacaatctactataaatcctaagaacccatcacaccccactgcccccaaccctggggagaaaactatagggttcgacgttttaatttattttacctaatgtagatgttatatatagatatataatattcataaattcatgtaagtgcataaaacattcagtcaatatattactatgtatgtgcattttaaaatatacttcatatatgcaatatgtatattttaaatatatggcatatattttatctctttgtaaccctgtgaaatagacattattattctcattttcatagatgaagaaacagaagaaattaggtaactttcccaagattaccaggtcagtgaggttctcagatgcaactaatagaaaccaaccctgaccaagcagaaaatcaatttgtcaatatgttgttgggaagtttgaaggatctacgggagggctggaactacaggtctagaagccgtacagccaagaacaccaccaccaaagaccctaccactgatgtcccaggtatagaccctgaagtgtgtcctgctcacagcaaacaagacagagcaagcctgggtaacagcagccttgggaagatggtgaagctgaggctgccacctttgccagaatggctgccacaagtgctgctgctttggcttacctgctcccattgcttcgtggcaagtgggtgatgggaggagtctcggctatgtgctggaccctcactgcaagagagactggaaggattttcacttcctgatgtgttagggggctcttcaacactggacagccaaataagaatgatagatgtcctgtgtgtctcacaaccagggtaggtggaactgggctttggtgccggctttgtttagccacaaagatttgttttactaccccttacagcagttcttggaggaacccagcagccagcttggcatctgagagtgatttcaggcttctagctgatcctagctgggcccagcctccccaaaacacatgtctgagcagtttttattttgaaagaaagacagctttataaatggaaataaaaatgggcctgaaacaccaattttgaaacttagggaaagtacaaggttatagtatagtcagttgttagagagtcactatgatataatcaacaacaacaacaaaaatgtgcaaataatgctggggtgagaactatgagattttctggcttgtgagaaagtggaacatcacagatgtccttgatgaaaacagatccgtgaaatcatctaagtgttttaaattttgtcaaccacacaggtacggcatgagcgtgttttttcaaagattcctagtaagtctccagttaccttgagcatcaccagccatctccagagaattcttccatataagaagctgccactcttttgaatttagtctagatccctttaaactagaaacatctgtgtgtttttaacccatagaattgtatcatacaaaatgagtagtcgtatttactgtctgtgcatttccttcagcactgtgtcttagagactttacgtgttgggaccaacaaacctaccttactggtttacgtactgcatagaatttcattatacaatcgcataggacagcttgctccaacagttccctattgatataggattttttttttgccttgaaaacaatgttccattgaatgtacttgaatatgtcttttttgtactatgagtgttttctccaaagtggctacaaagaagtggagtcactgagtcacaggggatgcacatttaaacattaatggcaccagcaaattgcccttgaaagggcctgagccaaattatgataccacttgtagttcagagagaagccattttcccacatcaacattagcacacttcttaatttttgcccatgtgaagtgctttttaatttgtatgtccctgagtgctggtgatgatgaacatctttgtgtttatttgttggccatttgtatttttaatttcatgtatgccctattcttattcttcctcatcagtatcctcttgcatttcatttctgaactcctgagcacgggtatagtctgtcttgttccttattgcatctcttgtgcccagtccaatatgtgtcatgaaataactgcacaaacaattgtgaaatgatccaagttatcaccacctctaacctaagcacggtttttcagtcttcagtcaagacacaatctgaaatctccttcctgggagtgagccttaaagcaaagtattagaccttttaaagaaaaatcagaccccagtcactttggctaacaggtggttggttgtcctagaatgctaggtcaaagccctccaggcaccctagaattcacccaagctgtattctagtaaatcagggcctgcagaagttattactttgactatgtcttttgtctgaccaagaccagccatgcattcaacaaaatgtgtccacctaatatgtgcttctggggggtagttattagcatttgaaaactaaaagatttcacataaatgtccagatttctgactttccatgacaaactatagacccagagacaccagggtttttagaagagggagattctctccagtctatcatcatccctgactacgtgggttctggagacatttgaatttgcaccctctggtttacaatacagttagagataaaagtaaacctgtgaaaaaaaagaagagaaatcctgcaatacaaagcagtgtgtggtaatataccaagtaggtgatatcatatggatttccagaagaattctgagaaagggaagggccttgaaggctgaggtagtcacagtagatatgttgtgtattagctgggccttaaaggatgggcagacattgctgggtgagggtagggtaagaatgaaagaaggtcaaagggaacattcctactgctcatgaatggtcttgaaacctgaaaagccgagtgaaaattttgtttgcattttccctctgaagacaggattcaatgcttccagcagattcttaaaagaattaatgaccccctcacctccacaaatggggaaaatcactggtagagggagacattgagagctaaagttagtgatgtgatctgggaactggcatagaggggcttggctgcccagctgaagagttttggctacatttcacccacctgcagctgcagaagcctgtagctgacaaggagtctttgaatgcaacccagagggagatataagcttccctggggatgtcataattgctaccatttactgcccactttgtatgttcctcacactatgctgaactttttaaaaaattgagatgaaattcatacaacataaaattaatcactgtaaactgtgaaatttagtggcatgtagtacattcacaacgttgcacaacaatcacacctatctagcttcagatgtttttatgacccaaatggaaaccctatgcccatgaagcagtcactccccactcctttttatggctgaatgatattccagtgttatgataggctacagtttatccattcatcagctgacgggcatttggaccgttttcacttttgggttactgtgaatagtgttgttgtgaagattcatgtataagtgactgaatcgttgttttcagttattttggatacatactgagaagtagaattgctgactcatatggtaattttatatttaattattctgaggctatgctgagctttctctgtgttctcttttttaatcttcttaaaaaattcagtgagaaaggattataattaccttacagataagaatgtacaggtaagaaaacaggcccagaaagtgaagtagtctttctaaggtagttaagtggcctttttaaggttgtgtagccagtaagtggtagagttgagatttaatcccaggactgactgattgcagaacctcaactcttaaccactatactaccctgcctttctatagcaccaaggaggatcgcacctccaaacgtggcaagaaatgagttagtttccttgctcaaagaactattaatgaaaagaaaaatgttaattggagaaatgttacccaatggcaattatctgttaaactgagtgggagttttgccgtgaaagaaaagcgaacaaagcctctgtattagtccattttcacactgctaacaaagacatacccaagactgggtaatttataaagaaaaagagatttaatggagtcgcagttccacatgactggggagtcctcacaatcatggcagaagatgaaggaagagcaaaggaacatcttacatggcagcaggcaaaagagagcttgtgcaggggaactaccatttataaaaccatcaaatcttgtgaaacttattcactaccatgagaacagcatgggaaagacccacccttatgattcaatgacctcccaccaggtccctcttgtgacacatgggaattacgggagctacaattcaagatgagctttgggtgggcacacagtcaaaccatatcactctctatgggtgcttttctgctcacctgtggaggcaggcatcactgccacctggaagaaatcgggacactcactctcccagcctcccctccttttcctgctcttgtggccaccccttcagcctgcactgcctctaagctctttaccctggaggacagtaacttcaattttagagaaactctaaagtggcttatatgcacaggaagctgcaaaaacatctgagcctccacttcacgcaggaattccctaccacttgtgagggagagcccataataagcggtgttcattaggattaatgcctgttgactgtgaaaacatgaaattgatcagaaagccagtttttgaaacaagactccaaggtgactgaggactaaggcaggaaggagggtgtctgctgggttcatcagaactgagtcctggtaactgcataaaagtgaaattgataatacaagagacatgattgctagaaagtgcaaacactgctgtggggggtgacaggcagcaaaatctgttttatttgctaccccagagaagtactgaagggcctagttctatccccagacactcccgtcctgttctaatgtggcatcttttatctacctactagggggagagggccacttcagacacctgagcatgttaataactggctgcctaccaaggtatgtgctatgaaagtgtaaagttgcatcttaacataagttttaaaattttcttggcatcagttttctatttcatagagactaaaatgattgggatatattttgaattataagtttatatgtcttgacttgtacttagctgttaatccaggatccttcatgtgcatccctagacctgtgcgtgagttgcctttcctctggtttctcactgggtttggtcaatggtggcagcagcaggagattggagggaaagaagtggaggaaagcctatttgaattcctacttcacctcctgatggggcacaagttggcattgttgcagttctctgttgtgggccgtcgctcctgtaaggtggccctctcccagagctgtaggtcttgttgagttctggtaactctccctccttctgtcctttcagtcttgggggtggtctcagcttcccaccattgctagccccggggagcttcattccctgttcattttcctcactttgcccacatttttctaaagagtccttttaacctttcaccccttcaacatgccatctctttcctaccatgaccctgactagtcagccacccaactcctctgtccccatgcagatatctatgagatggcagggtggggcaagaatcccagggctgggacagagcacgggttgactaagcatcagactgtagtaccatcatcttatgcctaataagactggaccagagatcaggggaactgagggctgaggagcctggtcagggaatgggacccaaggaaactggaagaaaagttgtctaggatggagcactgggaatagagaagagaaaaataacattccaaccagaaaaataatacagcaacttgagaatcaattggtgagatgatttgtgggttccaccctgcacacagagcttgctttcatagatgctcctacccctggagtagactttcccttttccttggtaaactttgagggaggacagcttccctgtgcacctgactaggccatctctccgccccttcagtccagaatttgagctccttgaaggttcttggaatgacctcagccattttttactcctgtcccttttcactcaaatggtcctctttgccagattttacaccgtgataattcttagtctttctttaagacttggtcaactatgataatgcttagtctttctttttttttttcttttttctttttttgagacagggtctcactctgttgcccaggctgcagtgcagtagtgcaatctcagctcactttagcctcaacctcccagggtcaggcaatcctcctacctcagcctcccatgtagctgggactatagacatgcaccacccctcccagcttatttttttgtatttgtaaagatagggtctcactatgttgctgtgatggttaatgttaggtgttaacttgattggattgaaggatgcctagatagctggtaaattattgtttctaggtgtagctgtgagggtgttgccagaggagactgacatccaaatcagtggactgggagaggaagacccaccctcaatgtgagtgggaacaatctaatcagctgccagcagggctagaatgaagcagacggaggaaggtgggataccctggcttgatgagccttctggctttcacctttctcccatgctggatgcttcctcctgttccttctgctcttggacatcagacttcagattcttcagcctttggactcttggacttacaccagtggtttgctgggggtgcttgggcctttgatcgcagattgaaggttgtactgttggcttccctgattttgaggcttttaggttgagactgagcccctactggcttctttcttgcccagcttgcagatggcctattgtgggactttgccttgtgatcatgtgagccaattctccctaataaactccctttcatatatacatgtatcctattagttctgtccctctggagaaccctaacacagttgtccaggctgttctggaactcctgaactcaagccatctgcccgcctcaccctcccaaaatgttgggattacaggcatgagccacctcaccaggcctcttagtgtttcttaagatcaactgggattctcagaaaatcttatctattccttagtctgatagaaatactcttctaggctcccaggcattacctgagtcttctctcccatcccttcactgccagaacatgaaatctgtccaacagggctttggttccatttattagtgaaaggggtagtttagaaaatgtggtctgaggaataaacatgaacattttgaacattttagagatctctggggcagtggaataaaaaaattctgtatctatgcttttggagtgggaaaggagcctccccaagaaattctaaaaagttatattttgtaaggcaagaacacaaacctctaagtatgaaaccagagtccttacacattaaagaagctggaacacgtcaacagtgggtacaaagggaagcaaaatccctcaggatagaaggaaacgaacaccttaacttttgaactcttaagggaagagtgtattttcttcatgatccactaagtttcttgccctcaggaacatttagaaaaatatgtatgaaaagaactatgtttatctggttgtcgtagtatatgatggaggtcctcgggaccactcccaggtttgatgaattgctagaagaactcatggattcagtatacagccatattgaaagctatgatttatgacagtgaaatgatacacagcaaaatcagcaaagggaagaggcacagggggtgaagtctgaggaagccaggcacaagcttcccactatcctctccccgtggagtcacgcaggacaagtgtaattcctccagcaacatactgtgataacctgtatgcatgttgccaagcaggacagctcacgagagaatcaggaccctgggtttttaaattggaggctagtcatgtaggcacccttttcctggcatgtaccaaaattccagatctcagtaaggagagcaggcgtttagcatgaatgatattgtttgcatgaacagtgttgatgcagtgagcccactttccagttctgagaatggagggaaccctctccaaatcaaagtatccaggtgtcagccaaggtccgaccttgcaggcagagctttctaagagcagcattcctcaggtctgctggttgctcttttttcctcaggaggtgtcatattgatcactcctagtaaaaggaggcagcgatgccattttccaacaaggggagttttctttccctcagatcccacaaagaactggagcttcctagaatgtcagctcggatttctttttccagataccttggcaatgacttccaaacctcaaaggcactgtaacagttgactttaattaaattattacccacatccctcttctcctttgccttccatcttgaggggcttaaacctaagctcccaagagccatccttgctgcatggaagactcatccctcagagatttgccaggtgttaaagcctatatttgatggttacccatcaaataaactcttttttttatcccaaatgctttatgttctgcacccatgggcccagcacccttgcagttactcccacactctcctggttcttgcccacccatgttagctagttaacatggacaggctatgttggcccaagttagccatgtgagcccattcatgttagccagttggagcccctgtggtatagaaaccttctctccctggaaggctcaacactttcccagtcaggtcaggctgagagtcaattcttggtgttggtctggtagccagcagaggatgtgggggcattgttttgttgggcacctacctcattagtggctttgctcattcttcaagggaaggggctctgtcttccagtgagagggaggaggagacttttgcaggcctaaagggttcagggggatcatagggttgaaggagctcaaatgcatgttttcaagtgtctccaccccaggtctcagagtcccacttcttcccataaggattttgactttggtggaagagatgtgcctaggctaagaatctaagaactctgaacttcagctgctcttacaattaggttctgtgtctgttcttcagctctgtctttatgctgaagaagatgagcatttctttaaataatgccagggatgctctctgacactgtttgctctaaattattgagtgactgccctgaggctgccattttttctcttggaggcattcatggtattcagtgacagccacctaatttcacggtccttagaattactgtatctctcactcctctccaacaccagagacactgcacaaaccagtatctccccttctgcccctttctggtcccggttctccacaggtgaaagtcttagcaatcatgctgtgcccacagatgatgatgctccacctcccactagtgataaactccacgttgccaggcaactaatcagtgatccaactccacagcccttcctttgagtctggttcttaggaccactctcttaggtcagtgtgggggggcagaataatggtccctaagtcattcatatccaaatccctggaaccagtgagtatgttaccttacatggcaaatgggactttgtgaatgttatgaatcttgacatggggaggttatactggattatccagatgagtctagtgtaatcacaaacaggtgatttttgactggtcctgggcacccaagggagcagtcctggccactgcaggaaggttagagtcagagaaggggaatctatttcagcagccttgtacagggcagaaattgtacactccaatgaggccaccttaatatgcccagccagagaaataagaactatttaaggaatggtggctttttttttttttttttttttgagacggagtctcgctctgtcccccatgctggagtgcagtggtgcgatcttggctcactgcaagctctgcctcccgggttcatgccattctcctgcctcagcctcccgagcagctgggactgcaggcgcctgccaccacgcccggctaatttttaaaaatatttttagtagagacggggtttcaccgtgttagcaaggatggtctcgatctcctgacctcgtgatccacccgcctcagcctcccaaagtgctgggattacaggcatgagtcactacgcccggccaggaatggtggcttttctagcctagttgctttgacctccaaatgcaggcttagtctgacttgcataaaataaactaggtgcattcagcagcctggtaaacagtcacttggtagttttgcagaatttagctgctttatcgcattctgccagcttctgttttagtttattcaagcaaccttggctggccctagttgactggtgatcttgctgttaatgacagaccactgacatgactgcatttgagtgagaagccccttggacttgccactttgcctggtctggggcctcgaagggggcagcgcttgtctctgaatactaattgttgctctgtcatctgactcaatcaacacaggaagtgggacaccagcagacagtcgccaatggagatacgatttcagccttaatattttaccccttgacagtacgacaaatgcatctaaactgatggaaaatgggattcttcactgagatgcactgtgccccagatctgtaatttgatacaaaagcttcacacaaatggaaattaaaatgcattttagatgcttcctcccatgaaagcagtttgcaccagcagacttctctctttcaggagttcgctatagaaataggagaaaccgggcagctttgctgttggcggctgtggaggtaacaatctccctgtgtgtcaactgtaggcaagaaaacgaaataaaatgaaaaccaagtggaggcctaattatccttttcaagatgacttcatcctgtagagtggcccattgaatactacaaggcactttcctttcccttctttaccccttgagtgtttggggccacattaacgggggcgggggtcacactgggattcagaagatggggtgcttaccatttgagtccaatttatttgcctaacaacacttacagaggtagtgactatccgccaagctctgtttaaaagctctccttagatagtaacacatttgtttctcagaatgactctgtgaagcaagtactgatgctattgctattttaggaaaattaagaaacagagagatgaagtgacctgccctatgtcacacctagtaagtggcaccagaattgggatttgaacctggtcatctgactccaagttcaaggtcttaattgatttgctatgttcttcctttctgtggtgaagaatctgggtggaatttggctttcacagagaaagccctaaccctgatatctttgtggtggggcaggccttggctacagcagggccagaggtgcagacccagctatgcttatagcacatattgttctgcggtagttttttttttttttttcttaatgtgatagtttggcacacgctcttgccagccaggtagttacttcatttacatctgcctaatgtttaccatatacattacccataatgtaatcactgttctacttttagacatcaacttgttcccaattttcggttattaagagcagtaatgtaataatgcgtatccttttatagccaggtttttaaaaaatacctggttatataaggatatgcattattcctttattatttttttaatttattttttatttcattaggtttttgtggaacagctgctgtttggttacatgaataagtgctttagtggtgatttctgagattttaatgcacctatcacccaacaatcgtatactgtacccaatgtgtagtctattacccctcctcccacactttcccctgagtccccaaagtccactgtattattcttatgcttttatgtcctcatagcttagtttccacttattagtgagaacatacaatgtttggttttccattcctgagttacttcacttagaataatggtctccaattccatccaggttgctgcgaatgccattattttgttcctttttaaggctgagtagtctatatacatgcgccacattttctttatccactcattgactgatggacatttgggctggttccttatttttgcaattgcaaattgtgccgctgtaaacatgagtatgcgtgtctttttcatataatgacttctttttctctaggtagatacctggttgtgggattgctgggtcaaatggtagatttacttttagttcttcaaagaatctttacattgttttccacattattacattatttaatagagacacggtttcaccattttgcccaggctggtctcaaactcctggcctcaagtgatctggctgcttcggctttccaaagtgctgggattccaagcatgagccactgtgcccagcctagccacgtgtgttttcttgtgagtttattcacagggtaaattttcaactgtgggattgctgggtcaaagggtatatatatttttaattgtgatagctcttgcccacttgctctccagagaggttaccccaatccatagtgtccctaaaagtgcatgaagagtacctgtttcttcacactcttcatgcactgtgtattagaaaactaaaaaagtgcctgcatgaaaaataagagatggtaattcattattatttgattaattatggtgtctcatcattgcttattggctagttgtatttatttttctgtgaactgcctacttgaatcctttgcccactgcttcccccagttgagttctttatcatttttttactgattcataggcacccacttcattgttttaagccttggggagcgctagctttttagtttatggctggccttgtactctggcctggaaagactttggttaaactaactttcctccttcttttcctttagttttctcccctttaatctttatttctgagtacagtgctgtgcaccctgtggacacaataaacacgtgctgattgactgttttatttatctgatttttatggcttctttcctctcaagagctccatagactttatagtcattaactcgataaccctcaaagtactctagtgtggcagcagtaatcactgtcagggtttttgagatggtgaaacagaggagcccagattctccagaattattctttgagggcctcaggagggagcctggtggggaagtttagcctgttgcaagctctggaccaaaagagtccttagaaaggttctagtcagaatgactgcaggacggtgaatgggtggtcgttgggtctacaaagatttcttcagacacccacccaaaagggaggctccctcttgaactgttctcagatggaagtaagactgaatagtagttgtgcgtgcctgagttcaaatcttagtcactctgcattacagctgtgtgctggggggctctgactatgcggcagaccacgtgccttgcttagccctcagaaaaatcctgtgacatgtcagatggttaaggaactggtccgaggtggcatggcactaagtagtgatgtttgtagtgagctagatggcagtccctgaaagctctgtctatgtcttcatctctggaacctagaatgtggccttgtttggaaaagagtctttgcagatgtaattaaggatcttgagttgagatcatcctaaaataggtggaccctaaatccaataacaaatgtccttatatgagacaaaagaggagagacagagaagagaaggccaagtgaagccagaggcagagatgggtaccgcatcccatctctgcagccacaagccaagggatgcctggaccaccagaaagtggaagaggcaagaaaggatcctcctctggagcccaccgagggagcctggtcctgctgacaccttgatttcgacttctggcctctagaattgtgaaagaattaatctctgtcattttaagcctcctaatttgtggcaatttgttatggcagccacagtgctgagatgagaacccaggcagtctggattccaagtccgtacccttacctgtgacactgtctggtgggcacatagctgcacctctctgagcttgttttctcgtctatatacaaggatagtgactgtgcctactccagagcgatgttttgaggcttaaatgagataatgtacatcaaaggtagagaagagagctcaataaatgttagctcttgtggctcctaggattgctgtttttactgagtgaccttaggaatggccacttgtgtgcagcagggacagacacattccctggggccaatacttgtcctatagggagggtaattccaaaatcttaggctaataactcaccattctgggtggttggtagttgaggaagtaccttggggacatcagttggtctccaggtgtttttcctttgtatttatctatgaattagttattttcatttcttttggtgtgtctttctttcttttatttttaatactaacaatctttatacttactgttaacttataacaatagttgtaagtatacatgaaagtatataatttatatacttatatatacttaatgtaagtatatatacttattttaaagtatacattaaagtatattaataagtatattttaataactatgcattaaagttattgaataagtatacattgaaatatattaatatattataactttaacactttaaaattataatataaatatatacttatgactaatatttttaaaacttttaatatatgaaattaatatatagtttataactttaaaatattaaagttataaattaatactaacaatttttatacttatattaatgagtttaatatgtttatactgtaatatatatttaactgtgtatggtaacatatgaataagttaatatattaaatttaatatataatacattataatataaatttataacaatatatcataatacataattcatattatatatttaatatataataccataataacttatattaaaaagctaatttaatatattacattaatactaataatctttatacttattgttaacttacattaaattaattaatatattaaattaacttattaatctggttaactattatatatagttaaccatattaaaatatataaatatataaataatacatgatatattatatatataatttgcattttattattatattatatattatatatttaatatataatatttatatattatatatttaataaataatatttatatattatatattcaataaacaatatttatatattatatatttaataaacaatatatattatatatataatatacaatatttatatattatatatatttaatatacaatatttatatattatatatatttaatatacaatatttatatattatatatatttaatatacaatatttatatattatatatatttaatatacaatatttatatattatatatttaatatacaatatttatatattatatatttaatatataatatttatatattatataattgattgtatcatacataattattatatcaatatattcataatattaatatatgaatactattaatatatgaatatattgctattcttatattaatatataagaattattatattatattgtattatatatactatattatagatttaataaatatcatttgtatattatgtaattgattttattatgttatataataatgtaatgcaaattatatataatatattatataatatataatatatattattcatatatttatatattttaatatgtttaactatatataatagttagcatattaataagttaatttactatattaattaatttaatataagttaacagtaagtataaagattgttaatattaacgtaatatattaaattagctttttaatatgttattattaaattaattaacccgcaggtctggtgatgcctgcggaggactcgcagtactcaggatatagtcagattcatgtgtaagttacattccagtgacaagatacaaagcgaaatcagcaaagggcacaggtgcataggtgaagcctggaggaagccaggcacaggtttcccagaggcatcacacaggccatgcttaattaccgcagcaatgagttgtgaaaacatgtggaatgttgccaaccagagatgctcactggagactccatgccctgggttttttgttgggggctgatcatgtaggcaccttctgctaataacataccaaaattccagactcccatgaggaatgcaagtgcagtatacatgatattgtttgcacaaacagtttagttagagtagcccccttaatcacttagggaatagtgggaaccctcctgaaatccaggttcccagaaactagctaagggccaaccttgcaagcaagcctttctaaggattgcagtgtcaggcctgctatgttaactcttttctgcatagagtgcagtaaaggttaataatttctaaatagtattgtatataattaatgcaaaacccttaaagagaggatagtattatttttcacaatttagaggtgaaaaaaatggagactcagagagtttaagaatctcatccaagaccatcactggtagactagaacccagacttgctggactgtaaccactgtccatgacagcctgcgcatgatagggtggaggatgaccgagagagaaggaattgttcacaacggctctaacagcacatgggctgggttatactgtggcaatccccatcatctccgtgatttaaaacaactaactgtatttcccacataagctccacatctgttgcaggtcagctggagtgttctgcatgttgtccttgctctgtgacctagctactgccagtcatcggggcaggaagaaagtgcaagtcacacatggtgcattggctcttaagggttctgtcctgaagtgtgatgtgtatcgctccatgggccaacacaggtcacatgacctcacctagcttgtggggatgcaggaggagtgcagtcctactgggaatattcatgaagagcacaaacaactgcacagcagccagacagggttggcttgtggttattgcatcttccctctggatcctccaaggagcccgctatgtccttttctgatacaggtaccatgaggatcttggctccattggtcctacagcttgtcactggagcctaggggcagtgtcatgtgtctgttctctttgcctcacacttgaccccacactagaatttacaaagattaatatctttggggcccctcctttactaagtccctgccttgcctgttctgcctacaatccaaagtcacatgaaaactggagctggagaaaaacctcctggctccatcaggctttttgaatgcctggcaaatattgcctagacatctgaaatgatgcgttctttaaaaaagaattccaggggtatatttattagcaagcatggatttagacagatttttcatgttcctctttcttggcagggcgtgcaaggatctcctgccagtttctgacagcctcgtcgctaggtgttaagtgaaaaacatcatcagcctggtctattgataggttcaagtgacagtgtatgttgccaatctcagccaagaatcacttctgacaattctcctctccaccaccgtgcttgggcgggaacatcgcttctccccctttccttgggagtttaagacgctgtaaccatattaaggctgcatatgtctgtgtggctgcaagcagtgggtttgtggaggaattaagcagtgcatatggcttccggcaggctgcctgtatcacggcagcctcgcccagccccgtgccaagtgaggctgtcgaagccgctgtgcctggtcctcctgaggagaggggcttcggccaaacttgttgattagtgctcgctgaggctgccaaaatggtctgccttcttggcaaggctggtgctcttacagaggccacctgactgacagacctcaccctgccctctccccccaccgtgggagagcagtcactgcttgtccttcagtttgcagcctgcaggtcaagcaagttcctcctcccctccccactggcacacacaggccaagtctagtccctcctgctccctccaatcttttcttcatcagggagtcagaatcttctcagaatgcaaagctgattgtggccaagaaatggtaataaaaataaaaattaaaaaaaatctccacttgattcccattgatgttaaaataaaaaaacaaaattttgagcacagcctgtgtggtatttcctggcccgcaccctcctccctgcctcatccctgatcaggcttcgtctccgtgttcaagccgcacctgccttcttcaggctccaccaatggccatgtccttctccttcatgggactttgcacatgcccttccctatgtccccagtctcttcttcctagttcattggctcccaaccttggcaacacatgataatctactagagtgcaggggaagggatcctgaaaatataaaggcttggtcctaccacaacagattttaatttatttggtctgctgagaggcctgggaatcagcattttaagagctatgcaggtgattccaatttacctccagaggtgggaacccctgatcttgttaattcctatacattctttggatctcagctcagtagtcccttcctgaaggaagtcttccctgataacccctaaaaggtcagaatattccaacttaataccactgaagaatcagcctgccttccctcacaggttggcacaaaagtaatcgtagtttttgccattactttattattattattatactttaagttctgggatacatgtgcagaacgtgcaggtttgttacataggtacacacgtgccacggtggtttgctgcactcatcgacctgtcatctacattaggtatttcttctaatgctatccctcccctagccccccaccccctgacaggccctggcgtgtgatgttcccctccctgtttccatgtgttctcactgttcaatcccacttgtgagtgaaaacatgtggtgtttggttttctgtttctgtgttagttgggtgagaatgatggtttccagcttcgtctgtgtccctgcaaaggatgtgaactcatccttttttatggctgaataggattccatggtgtatatgtgccacattttctttatccagtctatcatttatgggcaattgggttggttctaagtctttgctactgtaaatagtgctgcaataaacatatgcgtgcatgtatctttatagtagaatgatttataatcatttgggtatatacccagtaataggattgctgagtcaaatggtatttctagttctagatccttgaggaatcgccacactgtcttccacaatggttgaactaatttaccctcccaccaaccgtgtgaaagcattcctatttgttcacatcctttccagcacctgttgtttccagactttttaatgatcgccattctaactggcctgagatggtatctcactgtggttttgatctgcatttttctaatgaccagcgatgatgagccttttttcatatgtttgttggctgcataaatgtcttcttttgagaagcgtctgttcatatcttttgcctactttttgatggggtggtttatttttttcttgtaaatttgtttaagttccttgtagattctggatattagccctttgtcagatggatagattgcaaaaattttctcccattctgcaggttgcctgttcactctgatgatagtttcttctgctgtgcagaagctccttagtttaattagatcccatttatcaattttggcttttgttgccattgcttttggtattttagttaagaagtccttgcccatgcctatgtcttgaatggtattgcgtaggttttcttctagggtttttatggttgtaggtcttatgtttaagcctttaatccatcttgagttaatatttgtataaggtgtaaggaagggatccaattttggttttctgcatatggctagccagttttcccaacaccatttattaaatagggaatcctctccctattgcttgtttttgtcaggtttgtcaaagatcagatggttgtagatgtgtggcattctttctgaggcctctattctgttccattggtctatatatctgttttggtaccagtaccgtgacgttttgtttactatagccttgtaatataggttgaagtcaggtagcgtgatgcctccagcttggttctttttgcttagaattgttttggctatacaggctcttttttggttccatatggaaattaaggtagttttttctaattctgtgaagaaagtcagtgttagcttgatggggatagcactgaatctatcagttactttggacagtatggccactttcactatattgattctccctatccatgatcatggaatgtttttccatttgtttgtgtcctctcttgtttctttgagcagtggtttgtagttctccttgaagaggtccttcacatcccttgtaagttggattcctaggtattttattctctttgtagcaattgcaaacaggagttcactcatgatttggctctctgtctattattggtgtataggaatgcgtgcgatttttgcacattgattttgtatcctgagactttggagaagttgtttatcagcttaaggagattttgagctgagatgatagggttttctagatatataatcaggtcatctgcaaacagagacaatttgacttcctctcttcctatttgaataccctttatttctttctcttgcctgattgccctggccagaacttccaatactatgttgaatatgagtggtgagagagcgcatccttgtcttgtgctggtttttaagggaatgcttctagcttttgcccattcagtatgatattggctgggggtttgtcataaatagctcttactattttgagatacattccataaatacctagtttatcaagcatatttagcatgaagcggtgttgaattttactgaaggccttttctgcatctattgagatagtcatgtggtttttgtcacaggttctgtttatgtgatgggttatgtttattgatttgtatatattgaatcagccttgcattccagggatgaagccaacttgatgatggtggataagctttttgatgtgctgctggatttggtttgccagtattttattgaggatttttgcatcgatgttcatcaaggatattggcctgaaattttcttttttgtgtgtgtctctgccaggttttggtatcaggatgatgctggcctcataaaatgagttcgggaagagtccatctttttctattttttggaataatttcagaaggaatggtaccagctcctctttgtacctctggtagaattcggctgtgaatccatctggcctgagctttttttggttggtaggctattaattactgcctcaatttcagaacttgttattggtttattcagggattcaacttcttcctggtttagtcttgggagggtgtatgtgtccaggaatttttctgtttcttctaaattttctagtttatttgcatagagttgtttgccgtgttctctgatggtagtttgtgtttctgtgggatcagtggtgatctctcctttgtcattttttattgtgtgtgtttgattcttctctcttttcttcattagtcttgctagtggtctattttgttaatcttttaaaaaaaccagctcctggattcattgactttttgaagggtttttcatgtctctatctccttcagttgtgctctgatcttagttatctcttgtcttctgctagtttttgaatttgtttgctcttgcttctctagttcttttaattgtgatgttagagtgttgattttagatctttcccgctttctcccgtgtgctatttagtgctataaatttccatctaaacactgctttagctgttttccagagattctggtacgttgtggttttgttctcattagtttgaaagaacttctttattctgccgtaatttcatttttacccagtagtcattcaggagcaggttgttcagtttccatgtagttgtgtggttttgagtgaatttcttaatcctgagttctaatttgattgcagtgtggtctgagagactgtttgttatgatttctgttcttttgcatttgctgaggtgtgctttactttcaattatgtggtcaattttagaataagagcgatgtggtgctgacaagaatgtatattctgttgatttggggtggagagttctgtagatgtctattaggtccacttggcccagagatgagttcaagtcctgaatgtttttgttaatcttctgtctcattgatttgtctaatattgacattgggctgttaaagtctcccactattattgtgtgggagtctaagtctttttgtaggtctctaagaacttgctctatgaatgtgggtgctccagtattgggtgcatatatatttaggatagttagctcttcttgttgcattgatctttttaccattatataatgcctgtctttatcttctttgatctttgttggcttaaagtctgttttatcagagactgggattacagccccttcttttttttgctttccatttgctttgtaaatattcctacatccctttattttgagcctttgtgtgtctttgcacgtgagatgggtcttctgaatacagcatgcggttgggtctcgactctttatccaatttgtcagtctgtgccttttaattgggacatttatcccgtttacgtttaaggttaatattgttatgtgtgaattttttcctgtcattatgatgctagctggttattttgcccgttagttgatgcagtttctttatagtgtcgatggtgtttacaatttgttatgtttttgcagtggctggtaccagtttttcctttccatatttagtgcttcctgcaggagctcttgtaaggcaggcctgatggtgacaaaatctctcagtatttgcttgtctgtaatggattttatttctcatttgcttatgaagcttaatttggctggctatgaaattctgggttgaaaatcattttctttaagagtgttgaatattggcccacactctcttctggcttggagggtttctgctgagagatctgctgttagtctgatgggcttccttttgtgggtaacccgacctttctttctggatgcccttaacattttttccgtcatttcaacgttggtgaatctgacaattatgtgtcttggggttgctgttctcaaggagtatctttttggtgttctctgtatttcctaaatttgaatgttggtctgtctttctaggttggggaagttcttttggttaatatcctgaagagtgttttccaacttggttccattctccctgtcactttcaggtacaccaatcaaatgaaggtttggtcttttcacatagtcccatatttcttggaggctttgttcattcctttttgttcatttttctctaatcttgtcttcatgctttatttcattaagttgatctttgatctctgatatcctttcttctgcttgatcaattcagctattgatacttccgtgtgcttcaccaagttctcgtgctgtgtttttcagctccatcaggtcatttgtgtttttctctaaactggttattctagttagcaattcctctaaccttttttcaaggttcttagcttcctttcattgtgtcagaacatgctcctttagcttggaggagtttgttatttcccaccttctgaggccaacttctgtcagtttgtcaaactcattctccatccggttttgcttccttgctggtgaggagttgtgatcctttggaggagaagaggcattctggtttttggaatttgcaagctttttgcgctggtttttccttgtcttcatggatttatctacctttggtctttgatgttggtgaccttggatggagtttttgtgtggacgtcctttttgttgatattgatgctattcctttctgtttgttattttccttctaacaggcccctctgctgcatgtctgctggagtttgctggaggtgcaccccagaccctgtttgcctgagtactaccagtggaggctgcagaatagcaaagattgctcctgcctgttccttcctctggaagctttgtcccagaggggcacccaccagatgccagctggagctctcctgtatgaggtatctgttgatccctcctgggagctgtctctcagtcaggaggcacaggggtcagggacccacttcaggaggcagtctgtcccttagcagagctcaagcactgtgctgggagatctgctgctctcttcagagtcagcaggcaggaatgtttaagtctgctgaagctgtgcccaccatcagcccttctctcaggttctgtgtcccagggagttgggagttttatctgtaagcccctgactgaggctgctgcctttctttcagagatggcctgctcagagaggaggaatctagagaggcagtccagctacagaggctttgccaagctgtggtgggtcccacccagttcaaacttcccagcggctttgtttacattgtgaggggaaaactgcctactcaagcctcggtaatggtggatgcccctctccccaccaagctcgagcgtcccaggtcgacttcagactgctgtgctggcagcgagaattttaagccagtggatcttagcttgctgggctccgtggagctgggatccactgagctagaccacttggatccctggcttcaaccccctttccaggagagtgaacagttctgtctcactggtgttccacgtgccactgggagatatatatatatatatatcctgcacctagctcggtgtgtgcccaaatggctgcccagttttgtgcttgaaacccagggacctggtagtgtaggcatccaagagaatctcctggtctgctggttgcaaagaccatgggaaaagcgtagtatgcgggtccaaatgcactgttcctcacagcagtccctcacagcttcccttgagtaggggagggagttccctgatcccttgcatttcctgggtgaggtgacaccccaccctgctttggctcactatctgtaggctgcatccactgtctaaccagtcccaatgagatgaactgggtacctcagttggaaatgcagaaatcacctgcttcctgcattgatctcactggaagctgcagacctgagctcttcctattcggcctgctttgccattacttttaatggcaaaaaaagtgattacttttgcaccaatctaagagcgcaatacttaagagcctgagttttacccttaattttgtaagaactggattaatatctctcttcctggttggactttaagcttcatgagggccatggttatatataattttacttaacattttaatgccaatggtgacaagcacccaataggaggtcagaaaataataaaataaatgagtcaattctagagacctcccaagttcttcaggtagcccatctaatcccatttagatgttgggactattaaataggttttaatactgctttttggccaagcaattctcatgaataaccagtgaagaagaagaaggaagccaagggtgtctccttcttcagtcagtcctgagaatctgaaaccagtatcttcagtgtccaagagcagtcttgggtggggtggattagagtgtgtgaagttgtatggagtagaagtaggtgggcctgtatgagtggtggtcatatcctatagggcaggtgtggagatgaagcaggtgcatgtggaagaactgttctaagtataaagatacagctttccacgaacaaatagccagtgaattgggtgtccagtaaactcaatattctgacccagaacagtatgttcccactatctctggaaaggaaactgtttttcaaactggaaagattagtaaaattgtgacttaggaggcatcagcccttgaaaacaggcaaggctgaaaatattaaatggaaaatttcagaaataaacgattcataagttttaaattgcatgtgttctgagtagcatggtgaaatctcaagccatcctgcttaatcctgatcatgatgtgaatcatccctttgtatagtgtatctgtgctgtatgcactatccacttattagccattgactgactacttctgatatcccaccctccacattgtcatggctctgtgatccaggatcacccaaagcaggtgaccctccttctggcatattgttagaaggtgaacagtagcctaatgctaagtcacaatgcctatcccatccatttcacttcatcttatcacatcacataggaactgtgtcatcttgcattatcacaagaagaaagatgagtacagtacataagatattttgggagagagaaaaagagaaactacattcacataacttttattagagtatattgttaaaagttttctattttattattagttcttattgttaatctctttctgtgactaatttataaattaaactttatcatatatctatattatatatgtgaaaaaacatagtgtatatagtgctcagtactatccatggtttcaggcatccactgggggttttgaaatgtatcccccacagacaaatgggaactactgtgttatcttctctctcttctttgttctctacagatttttcctggacattgcttgtgccttctcagtatgtgtgactgattcttaaatccttatttcctactttcatctttctccatagctacagaaccaccctttcatctggaaattctgtttatttcaaatgtattagccaaagtggaactcactgtgtcttctctgcctcagcccaaatcatagtcttttgtattatttggggattgtgaaaagaataatttaattggcagccaggcttcagggtctccattgcttgcctttgggttgcagtttcttttagtcttttttttccaagtagactaggaaaagattaaacatcaccacctcattatcactccatctccattgtcagtaccagtaccaccgccacctccgctaccacagcattcagcaccatctccaccactgccaccttcagcgccatctccaacactgccaccttcaacaccatcaccactaccaccaacaccacctccaccaccatgaccttcaacaccatcttcaccaccaccacctccaccaccactaccaccacatccaccaaaaccgcatttaacaccgtcaccactaccaccaccaccaccattaccaacaccaacaacaataacaaaacaacttttgaagtgcccagagtagaaaaacacatagataacacacagattataactctgagccatatgtggcaacgaatttattctctcattgaatcctcacaacctaattaggtaggcactacccttatcactattttacaaatgacaaagccaagtcccagagaaggtaagtcccctgtgcaagggcatacagttagcaaactgaaagccaggatactgttcacctgcagagcccatgctctgaaccataccttcccatgaaggacctcatagatgaaatttacccacgctcctcaaagggtttatgcttctaggtttgtggtactaaatatgttgtgtcaccactgattgtgtagttcattgttaccatggttagacttagttttgaagggtggtggttctcctcttatttatcttccctctctggtgctaagccctgggcttagtacacagtagactctaagtcagtatcttaatttaaagtgaatgctagcaagactatgcctttattgttacgtggtgtggattttatgaggtttcctcaatgtacaatctgtgtgatatttgtggcagaattgctggagggaatttaaatattattttaaacatgttttaaggtctcacgcagaccacctgaatcagagtctgggtgtgtaacaaagtcatcttcatttaaagcagcttcccacgtaatttttaggttctttagttggtgatgtggtttggctctgtgtccccacccaaatctcatcctgaattgtaatccccacatgtcagaggaggtgcctggtgggacatgattgaatcacaggggcggcttcccccttgctgtctaatgatagtgggtgagttttcacaaaatctggttgtttaaaagtgtgtggcacttccccctttgctctctctctctcctctgctccactgtggtaagacgtgcttgcttcccttcccccttccaccatgattgtaagtttcctgaggcctcccagtcatgcttcctgttaagcccgcagaactgcaagtcaattaaacttcttttcttcataaattacctagtctcaggtagttctttatagtagtgtgagaacagactaatacagctggagacccactatggcctctttcagggctgagactctgtgatgatgatttcttattttgtccacacagaacagtaaaagatgccatggaaaaagtagttctgggaatacatttctaccagcatttgatctccgggattgtataaaactgtattgtttttattgtaagtttcctcaaatcctttgtggaatgagccaagatatataaatcaatatgaattaataaaattaagctctactgtttccctaagtaatcagacaatataagcctcaataacacagctgccctcatggctactaaaactctaaccctgcattgaccagaaggcatttccagcagaggcaagaaagaggcctaacaaggcagggctgagagtgttcttaagtatcaaggggtcaaaccatggaaagttaattacttccccactttgtgttctcttcctggaatgttcagatgtgagtttggcatcatggacaaagccctcacttggaaatcagcagacctgagcttgcattctgccacctctgcttgggcaatttagatagcttttcatagcttatctccgatcagggaaatgattgaagaagacctatttggggtttgtgaggattaggagcaatgtatacataaggccttgtccccatggttggcatgtagttggtactgtttgatgaatattgctttcctcttcttttactattattaaaaattatgatcatcataattctcattatttttactctcttccaccattaggaagaatcaaataaatgaactcttactactgatgttcttagaacctgttagccagtatgatgacaaattaagtcttacattaactctgagagttagaaacctatcttcatgaggtatctctgaagggacctccagcaatgcctatgtgccacgtaacctgtatttttagctaccaatttaaaaataaacctgtgaggtagactgcaaaaatggctacagtacacttgggagttccttgtgttgtgactttgcaattccccctcaccaattagacatggagtctgttttcccatcactggaaatctggaaatctgggctggactgtgattgctgtgatggtggacatgatggtgtgtcagttctgagcctaggtcttgcacttttggagacttgccactgccatgtgaacagagtcaggctggctagatggatgataagagacctgggatccagctacccctgaaatcccagtgataagctagccaaccattcactatgtgaatgaggccatgctagaccagtcagcaaccagccaacctgccaaacacatgagctggccctgctgagctcagtcaagcctggatcagataattggacccctcagctgacctggagacaatgaacaatgataaatgcttatggatttaggctactatgtttgagagtgttctgagcagcgtgatgagctactggttggttatatagcaattgctaactgatactcttgaatttgcagcaattcagtcattttggcatcacatagtagatcatcaacaggtttatttatttatttgttatttatctatctatttatttattttttgagacaaagtctcactctgtctcccaggctggagtgcagtggtatgatttcggctcactgcaacctccacttcctggattcaagtgattctcctgcctcagcctcccaagtagctggaattacaggtgtgtgccatcacacccagctaatttttgtatttttcgtagagatggggttttgccatattggccaggctggtctcaaactcctggtgttaggtgatctgcccacctcagcctcccaaagttctgggattacaggtgtgagtcactgcacccggccaacaaatattttagtgcctaccatagtcctccgggcatatggtggtgagcatggaagatgcctgacctcagggagcttacattagagaactagagtaacagaaatagaaacataaagcaacctgtgactccacttgagtatcactgggactaggagttgtgtttccagtccctttgatcatgattttgtgcagttttacttctatcaccttaaaaagaactgcatgtagcccggaagtgtatttaagggcacattcctctctggcaggatgacttcccagggcccatagtggcctggttgtcctcctgtacccttgagtcaggacatccctgaaggctacaggcagaaagagcttgcaacgtctttctcagctcattcccctggctaggacaccaagtcaaaatagttgatgaagagctgtcatctcttaaaatgggaaacctattgacttgttttctgagacagcagctgtgtttgtagcacttgcagtcaccacagcctattctgtacggtcctggccttcacactcaaatgtcaagtctctatttattcagagtaagtatctccaagggaatgggaagttttccctagagatggcactgagtcacatgaagttgggcacttcccagatatagtgattctctttttcctgtggtctcttgagattgagcatttttccaactaagcgacagattataaaatgaactctatgagttggtcagaaggtgtgcagtagtgttgctcataggtacaccaaactcatccaccccttttcaatgtttcagagcacctacctgtgccaggtagatgcggagatgaacatcatagcccttaccatcagagctcacagtttaaagtggagacagatgggtgtgtaatttcagcaccaagtgataagtactacagtgtgtgtttgcatatatggtgattagagagattgggaaggagtcagaacaacccaagattgaactttatagcagtgtagcatgatggttgggaatctggttagtctaggtttaaactctggctctgccacttgctagctgtgtgaccctgggaaaattaccttacctctctgagccttgatttgctcatttgggaaatgagaataatgacagcacttatctcctagggtaattgtaagaattaactcaattaatatgtatatactgcttaaaatagtactggtacagagtgaggactggaaaaaattataaatgaaaaataataaaacttcatcttgaagcataagcaggaggacaagcatcagggcattctggatagaggagagagttagaaaggtaggttcaagggcagcctggaaaggctttgaacatgactatgaagtatttgcaataatcttaagcagtgattctcaagctgtagcttgtgtcaaatcctcttgagggtgcattaaaactgagattgctggaccctatccccagagtttctgattcagctggtctgggcagggcccaagaatttgcatttctagcaatattctagatagtactgatacagttggttattcagggaccacagtctcttgcctctagtatgctctttttattttatgtttttttgagacagagtcacactctgtcactcaggctggagctcagtggtgacatcttggctcactgcaacctccacctacttggttcaagcaatccttctacctcagcccctgagtagctgggattgcaagcatagttgggattgcaagcgtgcgctaccacaccaggctaatttttgtatttttagttgaaacagggtttcaccacgttggccagctggtctcgaacttctgacctcaggtgatccgcccacctcggcctcccaaagtgttggattacaggcgtgagccaccacgtccggcctctagtatgttcttaatggctcaacttcccacccccatttggtgaacttgatacttggtccttgtcttcaggtctctactcaaacagcattttccccaggaaggcatcttttcaggtcttcacctcctgattggattaggtactcttcctggacagtctcttttacaaaaatgtttacatttccaccctgtgtcaatctctacctcccaatatacatatatacttttcccagggcaggaaataatctgctgattcttccccaggcgcactctctgatattaaggcagaataggctgggtaagggccaaaggaaccacacatgttcttgataggcccaactgcagaccccaggctgctgcatgacagctctgtccaccttcttgcctgcctatgcccaacatgtgcttaaaacttgcttcttctacctttcctgtctagccaggcccagctcaagccactcattcatcgcacaataacttgtatggagttttcttttggggtgataaaaatgttttggagctaggtagtggtggtagttgcaaaaaattgtgaatgtgctaatcgccactgaatttttcaccttacaatggttaattttatgttgcatgacttttacctcagttcaaaagacccactccctaaaatgtggaatattttaaaaaacccctaattttcatgaattcattcttccccatctccctaaagccaacctctattttaaagacaattttttgtcttcttgacactgacctccaataggcttctttgttagtggcaagagctgacgtgaagacttgatcatagtagttggatccactctaggaccttctctgtgcaccgagcctgctgtgttctcatcagtgcatagtcttattctgtcccaggcataggctctcgctgtttgttctctcatcccttctgataatcagaaagactcatcccttctgataattcagtcctcccagctacattttaccttttcaaagcattacttttgtaccagtttctctcacttgaagctattttaatgcgttaatcagtgttggcagtgaacttgctttctgtttacttggatttttgtctgttctgccaagtcaccctggaatgcaagctctgcggctataaggaacttgcctgttgtattcactcctgcatccccagtgcctggaatgtagcctggcacatagtaggtgctagaaagttcttggtgaatgaatgactgcaacagattcaggaagacatgccaaagtgggaggtgctgggctatttgcagggccagagttttcgtgctatgccttgaacgccagagtcctggagagttgcaggctttggcaaagttcatgttgcttgatgtaagcagaggtctgcttactgaggaccttcatgctgttgtttttccaaccacaggataagttgtctcagggcatgtccacatttcttctcctctggcatctttctcactcgggttgtgtagtaaaggattaaacttgctgaaaggaagatttagtccttgcccagttcctgggaggtaaccagtaagctcttgggatgtccttcctgatatcatgtctttgtttatctgggggtcttggttcattccagttagcttatgatgataatgtgatttatgggagagatcttgggctacaaagtgtcagcttgacttctgcaggggctggagactatggtcagctacacagcatgtctaccctatctacgtgactgacctcccataaaaacaccaagacttgggtgagcttttctggttgtcaaatactcgggtgtgtattatcacacatcatttctgggagacatagacactgtctgcacaactcccctgggacaattgtcatgcctcttctctcctggaccctttcccacgtgactctctcctttgctgattttaatctgtatccttttgctgcaataaaccataactgtgagtataatgagtgttctgagttttgtgagtacttctagtgaatcattaaacctggggatgatcttgaggaccccctagctacactggttggtacacagttggtacccaatagatgttgattgagtgcttacgaaactcagttcttgaagtctttcctatgaggcctggaagaaagaacagttgcttagtgtgtggttcctcctgtagtcatggacaaagggaacaatttctaccaaaggggagaaaataatttcttttttttttttttttacccggataaattctttagttgagacacttccctgaaaacaaaagtcagattaataagataaacaccagcagaagtttatggatgtgtgctatacccatcatttgagagagacctcagttcaaaagtatctctctcaaggcagtagcttagggtccttgcttaaatagtattttaacaaagggcaataaatcttagcatagtgacaagacaaaggagagagcagttccagtcttttagaaggcagggaaaacatggaaaggtagtaaaatctgttcccagattcctctggtaattgctggtgccttccgtagggcaataagcaagtgctgtctccagtaagaaaggatttatgtcctgtcatcaggcaaataaaagctgaggcaatgtgttcccctgcattttcagtgtctttaatataataatcctcaacatttttgggagaaacattttggttttctttactacaaagcagccagaatctttggagggcccacccatggtctcttccacctctgtaatgtcctgactgaggtgcttacaaggctcaagagaaattactcagagttccttgggtttttgcatagataaacataaaggtctttctgtaatgttcactccagggacacctctgaagactgtttgttgcacataagttacaaagtcagtacgttggtccttgaggggtggtcagtgggctgctatgctagttcagggaacaagatatgacctgaaagaactctttaacattcttgaaagtcttaacttttcagtgtatggggatggatttatattgatctattgtgtatatatgccatattttcttattggtccacctgttgatggacacttagattggctctatattttggctatggtgaatagtgctgtagtgcacatgcaagtgcagatatttcttcaacatacagattttctttcctttggttgtatacccagtagtggaatcgctgggtcatatggtagttctatttttaaatttttgaggaaacgccatactattttccataatgactatactacattacatttccaccaacagtggaaaaggcaagttccttttctccacatccttgtcagatttgttatttttttgtctttttgataatagccattctaactggagtgagatgatatttcattgtagctttgatttgcattttcctggtgatcaatgatgttcagcatttttcaatatgctattggctatttctatgtattttttgagaaatatctatctgcgtagatagatatttaaattgcccatttaaaaatctggttattattgttatttgctgttgagttactttagtatcttgtataatctggatattaatcccttgttgaatgatcagcttgcagatattttttcctcttcttcaggttgtctctttaccctgttgattgtttcctttgctgtacagaagctttttattttgatataatcccacttacctatttttgcttttgttgcctcagcttttgaggtcttatctatgaaatcttcatccagatgaatgttctgaggcatttcttctatgttttcttctagtagtttcgtagtttcaggtcatacatttaaatctttaatccatttgtgttgatttttttatatggtgagagataggggtctggctttattcttctgtatatggatatccggttttcccagcaccattcattgaagagacagtcttttcctcaatgtatgttcttgatgcttttgtcaaaagtcagttggctgtaaataaatggatttatttctaggctctctattctgttccattggtctatttagagccatagtagtattatgcctccaggtttgttctttttgctcagggttgctttggctatttggggtcttgtgtggtttcatacaaattttaggatttttctatttctgtgaagattgacattgtttatttgatggggattgcactgaatctgtagatcactttggatagcatggtcattttcatattatttctttcaatctatgaacatgagatgtctttccatttttatatcctcttcaatctctttcatcattgttttatagtttttattgtagaatctttcacctccttggttattgtgtatatatgccatttttggtagctgttgtaaatggattgttttcttgatttctttattagctagttgttggtgtatagaaatacgactgatttttctatgttgattttgtatcctgtaactttgctgaattttttgatcagttccaagattttttggtggagtctttagggttttctgtatataaaatcattttgtctgcaaacagacaatttgatttcttccttttcaatttgtatgcgctttatttctttctcttgcctaatttctcaggctaagacttccagtaatatgttgactaagagtgatgaaaatgggcatctttgtcttgttccagttcttatgatgctggatctgggtttgtcttagatgctctttattgtgttgaggtgccttccttttaaacctaatttgttgaaagattttattttttttaatcatgaaaggatgctgagttttaacagtgcttttctgcagctatcgagatgatcatatggtttttgctcttcattctgttggtgtgatgatttatattttctgatttgtatgtattgaatcatccttgcatccctaggatgaatcccacttgatcatgctgtgtaagctttttgatgtgctgttggacttggtttgctagtattttgttgaggatttttgcatttatatttaataaggctattggcctgtagttttctttttgttgtgtccttgcctggttttgacatcagggtaatgacagcctcatagaatgagtatggaagaattccctcccctttaatttcctggaatagtttgagaattggtgtcagttctctaaatgtttggtagaattcagcagtaaagctcattagtcctgggcttttctttgttgggagactttattactaattcaatctcattacttgttatggctttgtccaggttttctatttctttctggattaatcttagtagatttcatgtgtctaggaatatatccagtttctctaggttttccaatttgtgggcatgtagttgttcacaatagtctctaatgatcctttgtatttctgtggcactatttttaatggcttatttttcatttctgattttttttatttgggtcttctctctcttttttcttagtctaacaaatggcttgttgatttttgttttttcagataaaagaagtttcattttgttggtcttttgcattttttagtctcaatttcacttacttctgttctgatctttattatttatttcctcctaccaatttgggtttggcttttcttgcttttccagttccttgagatgactcattaggttgtttatttgaaatctttctactttattgatataggcatttattgctataaactactcccttagtactggttttgctgtatctcataggttttattttgttgtgtctctattttcatttgtttgaagacatttgaaatttttttttgttgacccattggtcatttaggagcatgttatttatttgatatatgtgtacaatttccaaagttcctcttgttactaatttctatttttgttccactgtggtctctccctttacatctaataatattggctttatatatgcatgtgctctggatggcgtgcctgtgtgtttacaatatcctcttgctaaactgatccctatatcaatatataacaactttctttgtctctttttagagtttttgacttaaagtctattttatctgatataaatgtagcggttcctgcttgtttttggtttccatttgtgttaaatgtttttccatccctttcctttcattgtgtgtgtctttacaggtgaagtgaatttcttgtaggccgcatattgttgaattttttttctccatttagcccgtatatatattttaattggataatttaattcatttacattcaaggttattattgataggtgaagacttactcctgtcattttgttaattgttttctggttgttttgtatatcttctgttactttcctcctctcgtattgttttcttttgtactttggagagttttttagtgataagatttgattactttctctttcttatttgtatatatagtttatcagtgagttttatacttttacatgtttttatgatggtagttatcatcccttcacttccagatgtaggactcccttgtgcatttcttataaggttggtctagtgataataaattccctctgtttttgctcatttaggaaagtctttatttctctttcatttctgatggctagttttgctgggtatagtattcttatctgatagttttttttttttccttttaacattttggatatattgtttcattctcttctggcctgtaagattatctgctgataaatctgcggttagtcgaatggggactttgcttatatgtgacttgatgcttttctctttctacttttagaattatctcttcatctttgacttttgaaagtttgtctataacataccctggagagaatttttttgggtcaaatctatttaggagtcattaagcctcttgattctggattttacatttctcccaaggtttgggaaattttcagctattatttcactaaataagctttttatttttattttttttgagacaatgtcttattttgttgcccaggctggagtgcggtggtacagttgtagctcactgaagccttgaccttctgggctcaagcagttctcccaccccattctcctgagcagttgagactaccagttcatgccgccatacctgactgagtttttgtagagatgaggtctcactatgttgcccaggctggccttgaactcctgagctcaagtaatcctcccatcttgacctcccagattgctggggttacaggtgtgagtcattgcaccagcctaaatagggttcttataccttatcttgtttcttctccttctagaattcccacaacacaaatatttgtttgcttcttggtgtcctataggtcccataggctttctttattcttttttatttttttttttccttcctgggttaattccaaagatctgtcttctagaaaatctttcctttgctcaatctagtatattgttgatgctttcaattgcctattttattttgtcattaagttattcaggctcaaggtttatgtttgtctttttgttatgataccatgttttttgaatttctcattcagatcctgaattgctttcctactttcattgaattgtctatctatattctcttgtacctcactgcatttcctataggtaattatcttgaattcttttccaggcattctatagattttcttttctttggagtctgttattggataatattgtgttcttttggagctgtcatgtgtccttgcttttaaatgtttcttgtgtccctattttgacatttgtatatctggtagaacagttacctcttccaaatttatggagtatttgtcataggtagatgtggcctatagtgtcaattgggtaggatgcttcaccttttgttcttggtggacacaggagtgtagtcttcatgtgatttctttgactttaatcaaatcagtgacatatttgagttcctcagtgatgtagactgtgggcatttatggaggtagtggcacagttttgctaggcatttggttaactggtcctcagtccttggagaagtgtatgctctgccaattgtatgggtggggttaccatgggtggtagtacgtagcaggcttgtccttggtcccttggggagagcaagtgcatgcatcataaatttatgtttattataaattacccagtctgtgatactctgttatagatgcataaaactgactaagagaaagggtcagcaaactttttgtaaagaaccagatagtaaatattttttacttcatggaacataaaatctgtgtttaaatgatctagctctgccattgtagcatgaatgcagagatcatttgtaaacaaatgggcatgatgctgttccagtaaaattttattaataaaaataggcagcaggacagatctggcccatgggctgtagttttccagtactttccctccattatgtcctcaagtatcttctgccaactaataacagactctgtgcctctttaatgagattcccaatggaggaacacactggctcaactcaatctatgaaggactattcttggatcaggtagcatcttcagccctttagctgtgactaaaaggtgatgggatcatactctataaacaaggtcaattggcccagaagcagggaatgcaaatatattattatatatgtctgttatttccacaaacatttgtattcagttccatttgatttcttgaggttatatggaaatctgggtcatgaatgaattcagctaattctgtaacctcatcatttttcaagcatctattgataatgagtgtgctcagatgctggaaatataagcagctgagagaacctcaggttacacttttggtctcagaggcggtgaactaacagcactcattcattcatttattcagtaagttgttattacgtagagtgttggatcatgtattcctctaaaacctggattccttctgtgggatgtgaaattgtatcctgttggcctgtttttgcagaatgaccatgtcatttagcaaggtataagggtaaagtatcacttagtcccaggtgggtccctaacttgcctgaatattgaagtataaactctgggaaagattctagaaaacattagagagggaaacaacagctcatggtcttaccatatcccttcagaaagaggcttgttgagtgtagttttaacatactattcaggaaatttgtaggaatattaaagcctgccttctaagctttatgaatctcaagcccagtacaaaatatttctttaatcattcaactctgagccagttacagaggacatatgtggcaggtcacatatctcatgagtaacagtactgtgaaaccctcaccctattcctcactattccccaacaggtgggatcacaaccaagaaatcagcatctaatatcttcagcatattatattcaaggagcttttatgttacctgtcctttctgccatttgtggttggaaatagctgggctaaaataagttggattggctactggtgaataataggtcagacaatcctaggagcaaaggtgtccattttgttttttttttcatatgagatctcactatgttgcccagactggagtgcagtagctattcacgggtgcagtcacagctcactacagccttgaattcctgggctcaaatgatcccctgccttagccttccaagtagctgagactatggggatgtgtctctatgcccagtttggtgccatttttacctcactggatatcaagagacagatgaagccaacattgaagtatgctgtgtttcacctttttgtggtatttgatgcagctggaagtatcagcttttggcaagtcttaagtcagcctgactgtcaatgagctgggcatcgggattgtgctatccatctacaagtattcactgaacacccatcactaatatagtctaggtaggttaaattagcacaactttgtttaaaatctgttttttatagaacatacatgtgtgcagggctgctccttttaaaattcattcaacaaagaccttgtccatgctatcgtaccctcttgactggatggctgtaaaaactcaacagatctctgattctattctctccccttactcccttcagtttgttctatacgcaacagccagagagacttagaacagatcaagtcaccccctgcttaaaatcctccaatgtcttttctcagaaaaaaataaactcagcattgctatgaaacctacatgacctggttcctacttttctttttgacaccatttgctcagtttcccttcagggactacgtgtaattacatagaattcttgtccatcttccagtttgccaagctgcagatcttttcacttgctgcactctctgtctgaggtattttctccctcatgtctacacacccttcattcaggtctcaactaaagtgtcattaccttagagacccttttcatgactactctgtccaaaatagctcctgccttcccaccattgtccttatatcaacccttttaaaaaattgtacagtagtcatcacgacttgaaatcttactacagtcttgtttgtttccttgtatatcatctgtctccatctctcaaacataaactccacaaaagcagaggcttcacctctcctgtttgccactgcagctgtagcaccttgaatagggccaggattatagaaggctattggatagctattgaatggataagtgaacaaaccccaagagccctattgatgatctatataaatatgtttaattatctcatagcgtattgggagaatttgttgggtgaaagtcaaacttacattccatcttaaaggaaacatccttaattcatttgctgacttgaaagctacattttgagccccttcagtgtgctaggcattgaggatgaagagaagtcacgatagaaaaggtccttgtgcttttagagcttatatctaagttatcattgatttaagaaaaaaaaaatgtgccacctactgtgctaagtgctttcaatacaatagcatgatggatgtgagggggttacgtgggatggggaaggaagctgcgataggagtgtatttgtttccaagggatgccaagacaaattgccataaatttagtggcttaaaacaacagaaacgtattgtttcacagttttagaggccaaaagtctgaaataggggtgtcagcgggactatacttcctcctgagttttagggagaatctccttagcctattctaccttctggtggatcttaatgttccttggcttgtagccacatcactgcaatatatgcctctacctttacatggtttcttttcttgtgtctctcctctgtgtttgtatgtcccatatctccctctcatttcttttacaatgataagagttactgtatgtaggattgtgagcagaagacacacaatatgtatgtcctgcaatccttgccaccctgtttgcatatagcatttttcaatgccccatgagcacagaattccaatgggcccataatgcatggaagtttagagagacttaaagtgagtacaaagtaagtgtgttatgtctaggactcagtaaccaaaggtgctgaccaccctaggatcaatgctttcctttcaaaccaggacttgctttgaacaccgaaggaagaggatggcattctaagaaacaaacgaccaaggaaccctatcagattctttcttactcatgttacttccctgcatgaggtgactacttatgctgaaaatgaggacatagaaggaatgggacagattgggcaacacagagtttcttttccttccagtccttccttatagtaaggtgaaggtggatagtgttgatagaatgtgttcctagaatataagaagtgaaataaagcagttgaatcagttttgtgcaacaatttcactgtcctggtaagagtataatatatatgcatgcatgagctgtggaatacaaattgtataatttcttttttttcaaattgtgtcatttctgtgattctgcacattagttaaattctcctatatgtgcatttaaaactgacactgcacaattcaaagatgatggtaaaattcatgttaacaagttaatgtgttaatttttaaattttttacttagaatggtgttaaatagcaaataaacagcatcatgacaagttgagagaaagattgtggaagaaaggaaaaaactgtacatttcagtatcattaacaacatgtttttctgcttttgaaacaagaggccccacgtttcatttcatttgcactgggccctgcaggttatgtgggtggccccgcaaagacagttgttgggcagaagccataagttctcaaagtgtgacctccagagtcctggctctgttaggctgtgacagttttcccatttccagcctcagcctcacttctgtggctagcagtgcctcatgtttgctttcccactcaggttactgggttttttttttttttaatgcttttaaagaacattttgcttttctcccatttctgtccttttccctcccaccatcattttcccaacgctcctggcatttcagggatacaaacaaaccatcaagaaacgaccagtgctggcctctggccacccgctgtgagagttaccactgcagaaccataggctgggtctgatgccctcagcaggacacattttctgctatgtttgagggaaagtggccaaaacagtcctctctctcacaacctcttcctttgtagggcagcagtgggtgcctcatggctggaaaactcactcttgctttctgcaaagaggacttttttttttttttaatcaactaagtcaattgtttgatgagaacaccatgaatggtccaccacagtttttgatgatatatttctgtgacggttacccctaactctactagacaagtttttcactccccacccctttaagcgcagaaaatccagagcagaaatttcagtgtgattgggaaattgtgaagactagtttgctcttgtatgacggaggatggcaggtaaacagagccaggtagaggaatgtttattggagagaagctttctcagaccagggcacatttctcctcagcagaatgaggggaaactgttaagaccctagcttgcatcccaagcctcctccctaatagagatgtgtggagggtggcaacattgcccaggactttgtgcaatggtggcgttttctgggcttttgttcctgcttccattgactgccagcttgagtcctagccagagccggtctgggaaccgagctttcattgctattgtagaggcaactgtggctttcactaactaaatagacgaggagggagaggcaaatatttgctgagtgcaacttgatctccactgcagggctttcatagtgtcgcatgactgaacttaccccatggccagacagtgtgccgggcttcctatcgtttacctcatttatttctcaccatgtggctatgtgatatggggactgtgacccccgctttaaagtaggaagctgcagctactgagagaaggcaattaattcaaaatcatacaacaataggaagcagagtcgaaacctctatccaggtctttctccttctgaagcatgaattctttccactgtgccatactgtcaaatcccgattgaccagtctttctttttctcttcttgcctttctctctctttctttgatctctccatctactcatccacatatctatccttccttcgtttatcatgcacttttccaaaagtgtggttaaggtactgatttcttattctgcagaatcgagtcctggtaagagtgatctcttgtttgaaatctctgtcacatatccagactgatttcctcactgcttcctgaacataacatatgcattcctgatcctacttctttcccttatcacatcctctcttagccatcaccacataccttctgccattcccttccatagctagctatctctcctgtcaaaattgaagcaaacatttattgaaagcttactttgggccagttgctgctatatgcacatcacctatatttacctaaagtctccccaacccagtgaggtgggtgcaattgttgtgctgtgttgttcaaggaagaagttatgttctgggttgttggtgatgggtgggggtgagtaacttgcccgaggtacatgggtaatgatgtataggtgttgtattacttcctattgattatgtcatttgttgctacatttcttcaggtagtgctttgggatagtcaaccattttacatggatatgtctcattttcccaaggagatgacctgtggtttgaagacagaaattctatcttgcaatcctttaagtatttcctagagttaaaggttgtacttgctgagtacacagtaccctatacaataatataaatacaaacagaagtgcacatgcctcattgagatgttagaaagtaccttcggacactatataacaaatgaaaagtttttgaattgtaggaatctggagctgaaaaagatattttgaaaaaaacagtaacctaggtttattagggtaaagctggcttctgtaacatacaagctcaaattgtaggttgccaaatgtttagtgttcaattctcatttttgtaaatgcaacttcctggatggcagatggctttcctccaagcagtgatttggagctccaggcttcttttaccctgttgctccactgtcttcaacatgaagcctttaagatcatggtgtttgtcttcatcaatccatagaggggagaaagaagcacagaagatccctcataggagggatggacaaggcagacctggatgagctgctcatcacttgcacacacatcttgttggctagaactctgttgcactggcacagccactgcaaggaagggtggaagatgtagactgcaggcccatgaagaagaggaagtgggttgggtgatgcagcaaccattgtcatgtcagagatgattgataagtttgctgtgccaactcttgtggattgggaaacagctgctcaacgtggtgcgtaaagaaggattttgaggctgagtccatgcttagaaagaaagggtttattcgctttgtcagacagtctgtgagcagggctgagggaggaggaatgggaatgcacacatcaatacttgctatccctgattctagtttgccttcttcattttatttgtattaatgtattcacctcagattcacagggcaactatcaggtgatggagactcgtagaagggtaagtcatggtctctccccctgcattgagctcaagtgattcaggagagagaatttatgatagagtgtggtccctgtgataaagggacaaggaccgagtcctgtggggatgcacagaaaagggctgtagaggagaggacaggcctcggagtcagtgacctgctcaaggtcacaccatgactatgcaccaggttcagaacaggaacaaccgggagtccttgtttataaagtgggagactgtcacctgcccctcaggcttgctggagataatgcacacagggctcacagcagaggccctcacagagtaggtgctaaatacacatgtggtgctattggtgactttctcagtttgtctgttatccagcaagtgtgaaatgaccattagggctggcaggtacgatatttatttactcaacagtcagttattggcagagctactgtgtgcctcctgctgttctgggctttgggggttgatattgtttggatatttgttccttcatatctcatgttgaaatgtcatccccagtgttggaggtgggtctggtgggaggcaattggatcatgagggtggattgatttcccacatttagcgccatcctcttggtgctgtcctaacaatagtaagtgagttcttgcaagatctgtttgtttaaatgtgtgtggcacctccctcccagaccttgcccttgctcccactgtgtgatgcgcctgtccccatttcaccttccagcatgagtaaaagctccctgaggacttcccagaaagctgggcagatgctgggcagaagctgagcagatgctggtgccaagcttgtacagcctgcagaaccatgagccaattaatttcttttctttataaatcacctggtctcaggcattcctttacagcgccgcaagaaccgcctagcgcagaggtaaatcagtgaatgaaacagacacatcctgcctttgttggacttacattctggtgtaaggaaacagataataaataaaacatttaagtgaatcagagagtctaagcaggttgggagtgccatgaaagatggaggatgctaagggggatcgtccatgactagtactgggggaaggtggcaaataaatctttacaaagggatagccagagagggcttcacaggaaaggtcattcttgagcaaaaacacagagatgtgcaagccttggctgaagtccttgaaaacttccaagggtagaattgtctcctttttttcagataaggacagcaagggtactggaggtaaagcagcctgtccaagctcacatgagggctagtatttgagccacgtatcttgactccagtggctcagaaggaaacaggtgggagggagcatgagtttgtgcttgacattcttggtctggaatgtaggcctgaatcagacagcagactttgatggtgtttttctccctccccgttcttaatcacactccgttcctgcatggtttctttacttttgcacaccacctatctagacgtaatgaataatatttggagctgcaaacaagagagcatttagtggtcatgaagccttgacaaaatgtgtacatggttttaaatattccattataatgcatggtgaggcgaggctaaaaatgagagcatataaaagcctgcgtgatttgattgatgacactctatcaatattgatggccgtgagcacattgggaagttgggaagctgtatttctacggtgtcctgctagcatccaagtctgcagggatgatatattgtgtgaaagcccgggtatcacactgctgttacactgacattaagtaatgataatggggctcagctttagtttgaagtcaaatcagttttgagtgaaacatgggctcgtctgtactgggtgctgggggttgggggtaggggcggttcccaggatcatttgatctgggactgtctatgaccattcctgtacactggctactcctgaatctgcgagaatgaggaagtgcttgctctatcccatgagatgtcactccatgagatgatggaggcagaaactggaatgatgtatttacaagccggggaatgccaggaattgctggcaatgccagaagctggaagaagcaaggtgggatcctctcctggagctctcagaaggagcacagccctattaataccttgagttttggatgtttggcctccagaactgtgagataatatatttttattgttctaagatacttagttttgtggtaatttgcataccaggaaaccaatagaaacactttctggcgtgtgaccttgggcaaattgcttaacttcctttgcctgcttctgcatctgcaaaaaggattggcattagtacttatttctctttgtgagaattgtgaagattaaatgagaaatccatgtagagaacttagaactgtgtctgccatgtagcgagtgctcagtagattttgttattgtttctgctattctcattcacatcttcatccttgttattcactggttccaactatgtgctaggctcattatgcatagcaggatctttttcttattttttaaatttttaatagctacatattttttattatactttaagttctagggtacatgtgcacaacgtgcaggtttattacatatgtatacatgtgccatgttggtgtgctgtacccattaactcgtcgtttacattaggtatatctcctaatgctgtccctcccccctttccccaccccacgacaggccctggtgtgtgatgttccccttcctgtgtccaagtgttctcgttgtttaattcccacctatgagtgagaacatatagtgtttggttttctgtccttgcgatagtttgctcagaatgatggtttccagcttcatgtagatcctaaataggatctgtataaaaatagttcctatttttccacatcctctccagcacctgttgtttcctgactttttaatgatcgccattctaactggtatgagatggtatctcattgttgttttgatttgcatgtctctgatggccagtgatgatgagcattttttcatgtgtctgttggctgcataaatgtcttcttttgagaagtgtctgttcatatccttcacccacttttcgatggggttgtttgatttttttgttgtaaatttgtttaagttctttgtagattctggatattagccctttgtcagatggatagattgcaaaaattttctcccattctgtaggttgcctgtgcactgtgatggtagtttcttttgaggtgcagaagctctttagtttaattagatcccatttatcaattttggcttttgttgccattgcttttggtgttttagtcatgaagtccttgcccatgcctatgtcctgaatagtattgcctaggttttcttctagggtttttatggttttaggtctaacatttaagtgtttaatccatcttgaattaatttttgtataaggtgtaaggaagggatccagtttcagctttctacacatggctagccagttttcccagcaccatttattaaatagggaatcctttccccatttcttgtttttgtcaggtttgtcaaagatcagatggttgtagatgtgtggtattatttctgagggctctgttctgttctattgatctgtatctctgttttggtaccagtagcatgctgttttggttactgtaggcttgtagtatagtttgaagtcaggaaacgtgatgcctccagctttgttctttttgcttaggattgtcttggcaatgtgggctcttttttggttccatatgaactttgaagtagttttttccaattctgtgaagaaagtcattggtaggttgatggggatggcattgaatctataaattgccttgggcagtatggccattttcatgatattgattcttcctatccatgagcatggaatgttcttccatttatttgtgtcctcttttattttgttgagcagtgttttgtagttctccttgaagagatccttcacatcccttgtaagttggattcctaagtattttattctctttgaagcaattgtgaatgagagttcactcatgatttggctctttgttattggtgtataagaatgcttgtgatttttgcacattgattttgtatcctgagactttgctgaagttgcttatcagcttaaggagattttgggctcagacaatggggttggtctcaatagactaggtactgatgggacttatctcaaaataataagagctatttatgacaaacccacagccaatattatactgaatgggcaaaaactggaagcgttccctttgaaaactggtacaagtcagggatgccttctctcaccgctcctattcaatatagtgttggaagttctggtcagggcaatcaggaaggagaaagaaataaagggtattcaattaggaaaagaggaagtcaaattgtccctctttgcagatgacatgattgtatatttagcgggatcattttttaaagtgccctcggaaagctgggtggtaggatattgaaatcgcctttgcaaaaattataactgagaaaatgatgacactgagagaaatctgacatggctgattccattttgtctctagcctcacaggttggctgtctttgctcattcctgagtgtgggccaagctaactttgggagaaacttagtttatagtttaaataatagcccttccccaaaactagtctgttcttacaaaactaatgaaagtccaccaagttaggatgagtggggcttgaataattaccggccattattccagaggtcatatgatttgcaacttccccaattactcctgaagaaaacatcactattgtagaacctaagactggccttttgagatgtcttttcaggtttttgcatttctgacaactggatggcctcatctggacctgccaagctaatgaaggactactagattaggagcatgtgaggaacctgaattctgctaagatgtagacataaactattagcagccattattccagaggtcacaagatttgcaactttcctgattattcctgcagataacatcagtattgtagaacctaagattggctttttgagatgtcttttcagggtagttttttgtatttctaaccactgatggttccactgagacccactcatggtcctgtggctccactcagaagtcactcagcatgcataagggccattttccgtaccgctatgattgtatcctcaaccaatcagcaacacccattccatagccaccccatccccacaaattctctttaaaaaactctagcctgctaatttcgggggaggctgatttgagtaataataaaactccattctcccatttaactggctgtatgtgtgcaaatctccttctctattgcagtttccccgttatgataaatcagctctgtctggacaatgggcaagacaaacccattgcgccattacaggaatggtaaggggacttagtagatgtgattgaggactttgagatggagagataatcctaagttatatggataagtccctaaatgtaaccacaagtgtctttgtaaaatggagatttgactgcaagggagagaaaaggtgatgtggtggcaatggaagcagagggggatttgaagctgccaatctgcggctttgagaatgaaggaagaggctatcagtcaagggatgcaaggaatgcagctctggaagccaaacaggcaaggaaatgcattcccctctaagagcttcctgagagtttgcagccctgccaacaccttggtttcagccccgtgaaacccattttggactcctgacgtccagactgtaagagaataactttgtattcctagaagctactaagtttgtggtaatttatcatggcagtatgaatccaaaatgtctgagacagatctcagtcaatttagaaagtttattttgccaagatcaaggacatgcctgtgacgtggcctcaggagctcctgacacatgttcccaaggtggtcggggcatagcttgattttacacattttagggagacctgagacatcaatcagtatatgtaagatgtacattcattctgtctggaaagctggtacaactcaacatggggcgggggcttccaggttataggtaggtaagagacaaatggtcgcagtcttttgagcttctgattagccttttactgaatatacaatttataggaatagtcacttatgccttagtctggcttagtgaaacaataggtcaaaggaagcagtcagatacacatttgtctcatgtgagtagagggatgactttgagttccatccgtcctttgtccagaaggaatttccttgtagcttttttatctttgtagctatcttagttagaaatagaataggaggcaggtcttcctgacatagttcccagcttgacttctccctttggcttagtgatttggggtccccgagatttattttcctttcacagcaaaaacaggaaactaatacataatgaatacccaactttctgactccacatctatgtgttcacttctctctcgctgttgaacattggttctcttctcagtaaactcatggccctgtggtgtctggttggtggctactccacattgaaaactgacatgcagattgcgggcaggggcaatcccaggctgctccttcatgcatcactacgaacagcagtctgaggggccagtgtttcttgcttctggtgacagagcccaacaggggatctgggtcctacactcaccattatgtgatggatctggcttctggtcccaaattctgcttcgtccccaggaagccaaagccctcaccagcagcgttagtcctaaaccaggccaatcctgtagctggttggggtattgaagacgctcaagtttggagttttagaaccaggtgaaactcaatgttggtttcatgatatagtagaaggaggttgaacttccaagtcagacccaggacaaaacctcaggtctgctgttgatcccctggtaacctctctctgtgcttcctcatctccagaatcaggatcatcaccctacctcataaggttgtaagaaacattaagtgaaaagagaacttggtatacacaattggttgtgggatgctagtccctttctcttcctccccacttactttatcttcacttatggaacctggggaccagtcttcaacgtcctgggctatggttctggctctgttcttagttgggattttcctaaatatctggcctggtttgatccagaattcaaactgaggtcatgaggggccccttgcttactgacgtcagaaacggtgtttgtggctgttggtctcctctctagcattcttctctgcccagctgcacagagcccctcctatgtattaattgggaatattttcagtggcaataaacaaaagctctaattcagcttgtttaaacagtagagaggattccttatctcccataattaaaagtcctgaagtaggtgaaaaacccaggtattttctttctgtcatttttctctgacaatctttgcataatggcttatctttcagccttgcttttcccttggtaggaagatggtcttggtaccacatccaaatatggatgtctttaagaagagaggtcctgctttcctctcatcttctcctctcctccctctttttgtttcccttcattccttgggaaaagaaaacctttctcaagagacttccccaagtcctcccttcgagtctcattgcccagcatagtgtcacaatcctaacccatcactggcagaggaaatggattactgtgattggctaggaccagacataacttacgtcctgggaagagaactgggggtttatctcctttgaggtacgtggctgagtaaaggagggagtagctacttgagcaaaactggggctttcagaggaagggtaaatgggtgttgggagggtggccaacactgttcgcctcccctcatagaactcttggcaaatgcttggattggaagttctgtctaatctcaaattattcagatggagagcgtagtgctcatcatgcatgctaacttgcattgattggtggtgactacctggaatgagatgttgaggattctggccacatctgggctcagtgggaatgacagccatgattgattaacaatgtctgccagcgggggggttgggggtatgttagagtggaaggttagcagaaaaaatttcttcctttaaaacacacacacagacacacacacacacacatttttttcaaagctctaggtttgtcttcctcaacttttcgacttcccaaggactgcttgtgatcctagttttcagaaaccatgtttacacaaatcacaggcaaatatgttacagaaaattaagaagtcacttatggatgggatctttatctctttgatttctgtcaatgtcttgtgcagctccttgagaaggggccacaggtctctggcttcctcttagttgagttcaggcagtattcagcagcaaactgaaaatgcacagatgaaaatgcaaactgaaaatgctgcctccactcttggtgccaccagtgtgaggctgttggtccagaggtggaagatactttcagaacagctcagcaatagtttttgctcaacttcaaaagaggcgtctggagcccatcttttctgcccagagacttcattcccactaaaggaaaatttccctgcacttgtagttctgcaattctgggtcagccaaatgagcagtattttaattttaaaatcttagccaattatcaagagggtggctttcttccgggtatcagcagcaccatctctctaacagccttttcttccctcctcccgcttatctttggagaccagccgagcccagctgcttagtagatgtgatctccccaggcatactaataatggggatttttgttttttttcggagcaagttttcattatttggagtttttgtctgtttgtcacatgtccagctaatttctctttgttttcaaaacaaaggatggttctaggaaaatggggttgcatttatgttgtttctgaatttccccttcctcctccctttctctccttacagtaaatgaagagtagttttttttttttttttcaggttgtgtttgacaaatctctggacacagtgagataattttgcatttctaaatgcagtgaaccacatgagaaaagttaattaaactggctgggatacgcatatctggtgatagatcaggaaaactgtcacatttctcagaataatcacaaccaatatagacacctcaaatgctccttgttattggttaataaatatagcatttggtactcaaagatacccctaagccattatttttttaaaaaattgtcattaaaggcattatatgattgtataagctcagcagttcattgctgttttttcctccccacaaaccccagtctgaaaaattgtcagtgtacttcagtcaatatatttatggagagattatctcactaactaagagagtgactatgtcttaattgacctgggattgggtccaagcacctattttagagctccccagctgattctgttgtgcagccagggttgaaaaccactgttctaagagtcatgttttatatctgtcagaataggttacattctgctgcagtaacaaatagttcgtggatctcattgacttaatgcgatgaagggtgatttcttgcacttgctacatatgctcagtgggtgggatgagtgctctgctctacatttcctgtctctaacacccatgctgatggggcttactgtctggagcattatctattgccattgcagggaagaaacatgccgtctctaacgtctttcttttggatgtaacatacttcacttctacacatgttattagcccaagttattgccatgtctgtggttagcagagacccggagatcttcagctgacacacagcttggctcaggcacatgtctgaaggtttctatcctgaaagacaaggtcaaggccagatggcaggacattgttttgctgtccttcagcctaacacatgatccaaggagttctgttgtcttctcttgtgacacaaagctcagtccacggccctctaggacagggcagttctgatggtgacatttcactaggtaagaaggtgtttgtttgtagcaaagcgttccatcagaaaattcccttactgagagccaagaaggagctgagagatgctcccattttcacttgcaagatgaaagcagtatccattgaagaaggtggaatatgcaagacacacaggaatgtgtatgggcaaaatctcgaagtttagaaagctgggcataccctcaatttgcccttgactcttcacaataaaatctaggagctgaatgaataaaaaatatccaaattttatagaatgtaaaaagtgatctgaatctcgagtaataataagagattagtcacctgttctaaactgacagcccctgatgtcatggtttccagtgtttttcaaatcacccaggatattgttgaacatacagattcctggcaccacctctagggatcctgatgcagttggttgagagtgggttctggacatgtcactgagttccccaggtgatgttgtggtggtctatgggaccaccctttctgttctcttggagacagccagggaggcagtgatcagagaaccagcccggtgtgagagcttcactacccacttgctcttatgatggctgcctccagagctgggaaactcactgttctggttgtcagctatccccaaacaatgatgaaatcatggttatttgaaccctccccatcacaaatgatcattacccagttgtcatccgttatgctttggtgagggttcttttctttctctgaaaactcaaaaatagaccagtgtattagtcagggttctctagacagagggagctaataggatacatgtatataataaagggagtttattaaggggaattgactcacatgatcacaaggcaaagttcacaataggccgtctgcaagttgaggagcagggaagccagtggtggatctgcctgagtccaaaaacctcaaaagtagggaggctcacagtgcagccttcagtctgtggccaaaggcctgagagcccctgacaaactgctggtgtaagtccaagagtccacaagctgaagaacttagagtctgacgttgaagcgcaggaagcatccagcatgggagaaagatgaaggcaggaaaactcagcaagtcaagtccttccatgctcttctgcctgttttgttatagctgcgctggcagttgattagacggtacccacccagaatgagggtgggtcttcgtctcccagtccacgactcaaatgttaatctcctttggcaaaccgtcccagacacacacccaggaacaatcctttgcatccttcaatctaatcaagttgatattcagtattaaccatcacaactagggaagaacattagcaatcacctggtccaacaccttgattttatggaccaggaagcttagtcctagaaaaaacatggtcatgttgcagaagaattcagtggcaggattggaagaggacccgaacagtccacatcaatgctgcctgcaggagaaaccaggcaaaggggtgaagaggtgcttttctgtcatctttgggacagcaggcagggcagttttaagtggttttgttcagcctctccacagaatgcatgagaaaatgggctcagttctagcagaagtcctagcagtagcagggtaatgtctagcagagtaaccctgggcaagtcacttagcctctctgactcaatttgtaaattgagataatgatagtgcctatttcatttttgtgaaaattaaatgagcatgtgtaacatgcttagaaaagtatatggcaagtagctatcatttatcacatgttcatgattgtcaatattattattgttatcattgcaataagtttcctaatgttagcctgattaaaagatacaataagggataagaggatttcacaatctttgtctgcaggcagctttaagaattagactggcatttgtctaggttgattatattattcatcttctttggatggagggtcttggtctaattgaacattagttttcatttttccataaatcatttaaaaataatctaaaccgtaagacagcaaggaaactgcctaatggtgagggaaacaaaaatcagacaagcttttctagcatgctacatctaccctaggtgacttccctgatgggtacatcaatgatagagggacagaggttaagccacatcgatttgaaagctgatattggacccttgcaatgagctctctgagcatccacatcttggacagccctgaaggtagacgtgcatccaggaaatagtagtggctgccctgtgtttgtgttcagagcctggtgctaggtggtatttgttaataggagaggaaacacctggggtcacatcaaggaaaagacggacaggggtagattggtagctgaagaggtggccatcctttctcagagctaccgtgttcaattcagggatgccttggtaattctgccccctgccttccaccaggagtgtgtgcagctctgtgcctgtgtccagcacaccctatgtgctaaagtttcctaaccttagcgggggtatgaactgtttgcccaggaatgaatggagatgtgatgtgaactatattttgtcccaaacaagaagagaaatctcagcacaagagaaacaaattatctcacaaataagtgaatctattctagtaattgagcagaactccaagagaaaatcttcacgatcttactggaaagctttttacaaagaataagtgtaagattgccagtagagaatgccaatctgtggagatgcccagcccctatgttggcctgtccatcatggttagctctgattgggactgtgccgaaaagaagggtaagcaggtacagatgacaagagtccaaggcctgtgacttggggacaataagcattataattgcatacaattactgagcactcactctgtcccagacatattttatatacatcaattcatttgatgctcatgttaggtagctgctgttactggccaggatttcaaagtagctactcctattgtcctcatttttctgatgagagaatgaagtacagaaaggccaagcaacttgcctaccttcttacaagcaggatgtggcagaggataagctcgggaagtctgacttaaaaatccacccttttttacaatgcagctaagtgatgatataagcaaacatggaaagatactgaaacaactaataagggccacccatgcacctgtagtcaaggccttggctaggagaagcagaaactccaactagaaaagggaaaggagatagattaatacaaagagaagtgaagtttctgcaggtccagggaagggagtatagctgagccttggggaaactggaatgctctttctctctcagcccctctgagatcataggttctagctcgtggagctgacttctgcttcctatctctgctgtattctagtcacaggccagctctctcaatctcttcagtctgtcccttgcaccattgtctggtatgggactgtggtttgcagtgggatccattgtgtcctgattctaaagacctcttagccccagagtcccccacctactgactgcatgctagctcctacgtcaagaaggagcatctgattggctcaaccagacctatccattggcttcccttgagtagggcaagcattgtcattgaaattcccctggaatcagcaaagagttaggggtagcaaaggggatgtctgagaacagagtttcctaaacattttttttttttttttaattcagagattcccttcagcagtctggtgaaggccagggacatcttctcagcatcacgcttttaaataaaaaataatgttggattacaaaggcagccaattctattaaattacaattattagaatattaaacaaaatttgtgctgtgtttttaaattaacatattgctgagatctagcagcaagtctcataacaactacaattttgaagaactggtgaatgtaaaagatattttgagataactgcaaaacttgtgtgatagaaaagtatgagttgcattggtgacaaagtcacaggcactgttagtacaactgtcgtttgtggcctatatttattattaagggaaatgctaattttcaatttgaagatgttgaaaatgaggctgcaaaattctttcccatccacgttcatagaatcctaaattctattcatagactctcttaccctgttgcagtatttctcaaagcatggagccacctacataaacaaggcatgggaagtggagaggagtggcaccatgaaggcttctctttgagaatgcagattcctcagttgtcccgcgctaggtatgctgacatctgacctgagagaaagaaactggaaactgacatagcaaactcatttttattgtgttcctgatgcaaatcttacatatgctaaattttgaaaaacatcaatgtaaagtagaaactttaaagcctctgagcattactctgtctagccatcaagtggggttggagtctgaaccaatgcagtcatataaaaagaaaatgtttcaaatgcaagcataggttttgaaatgcttagaaataacctagtgatgctgaatgcaggcaaattcaaatgtttttttcaaagataccttgtggttcatttaagaggagagcttcagagtacatctgcaacaggtggaggctgattggattaggtaatgcccaagagcaaacgcttttctgagtcaattctgaagcctgttgcctactggagtgaggacccttgttcatttgcatgaccaactggaggccaaagcaaaggatgatgcattctacggggttaaagggggaaggaatgagcagttgcagccccagtgcatcaggaaagaagaggctgagcattattacttctctctgggacgcaggaccttccagactgtgaccggaagcaaagtgcaggccaagagcagctggcctcctggtaggcagaatgagctcatagctgttggttgaagacacgtgaagtctgcagaggtgaactaatagcgagaaggacagagaggaggagcagggtgaagcaggaataccagccaagaacaagggcagctgatgcacccaggatagagagaacactcctcggcttcttgctaaaggagaatactttccttattcttgtggttttccatctcaggatactgtggaacttcctgattgggactcaggctgcttcagtgatgtcttgatgtaggacctgtcttctggccacaggtgatttcacacctgccatgatgggtagggagcatcttggggaagcagaggtttaataggtaggcaaattgcccagcagtcaagttttctcttcatgctagtagcagcacatcatagcggttgacgatatgggctcaagggcttgtgctggaatcccagctttgtcatttatcagctgggtcaccttggacaggtactaatctctctgtgctatcattttcccacttgtaaagcagatataatagaacttccgcatgagaatgttaagaaacgtgagctaagtcacccatgtaaaatgttcaggattggtgcctggtaaatagtgagttcattctctctttcctgctccctctcccacttttccctttctctctctctctctacatatatatatgtgtgtgtgtatatatatatacacacacacacacacacacacatatatacatatatatatgtttgttttgttaaataaagaaatgttgacgtgtcaatcacatcattatgtcaattatgtcaatccatttgatgaatgattcctttggtgctatactcagtcatggacagagttatggagttaggtggacctgggatttgagttctttgctatgccatattctattaactttgtaaccttgggtttgatcttggcttttttgcttatgagttctttgactttgggcagactagttggcctctctgaactgaattccctcaattataaatgtgactaaaatatcttacttctataataatagtgtctgatacatagtacgtataaaacaaacattaatcctttccctttacttcccaagtcacctccttaggttgggccatgtcagaacttattccagattcatccagcattggagagcaaatttggtgttggatactgccacaggccctactatacagaaatgaaaagagcctattcctcctcccaggggtcttgtggtttagttctctgtaacttgcaaaatgctgtaaaaatgaagaacattatgtaataattcttaggaagcaaacttgctgctcaagtagcttggaacaatgtttcccaaacttcactgtgcacaccaatcacttggagatcttggtaaaatgcagagtccagtgcagaaggtctggggaggggactgatatcacatttctaacaagcttccaggcaatgccctgctgctggtccatggaccatggactgcactttgagtagtcagggcttggagtatagcttaggagacaaagcaaacccacaggaatctaatcccttgctctaagctcttgcttcctgtttttgtttgaagggctagattcccatgagcattcaggcctgagatgcttgctttacaaatctttctgcttctgcatggtcaaaattcctttagtcctgtcttgtaggcctgtggtaattttcttggacagtgtaggtgactaatggagaaattgatccagatgttccctggagaataccaagaagctgccccaaagatccatagttgcaggttgtgcttctagaccacagaggactttggagagttggaagggacaattgtaaggtcatctggcctagcaactaccccactgagcttagtgtcactggattcccatcaaggacttaaaccttggctacgggctcatcttttaattcccttctttgaatctgaaatcagtccaattgtcaatagaatggtgcagggtttgggtttgcttccaggtgacttttaatctatatatgtttggtaaaactatatttggaaagaaaatcattgaggaactgataaatggaaagactgtgaatgagtagaagtgtaaaatgataacggggtctccaatttgcatttaaaagaaaatgtctaagcctcagctctcatgatgacgatggtaataattgtagcttctgttgtttgagtatttattctgtgccaggcctgtgccaggagctttacatatattatgtaatttaatactagggagataggtgcttttattttaaagatgaggaaattcagaagctaaactagattaagtgttttgcccaaggtcacacagctggcaagtagcagaagtgaaatttgaactaaagcagtttagctcccgaatatttgctcctaaactgtactcctgcctcttactagtctaacatcccatgtcctgccgagaatctcatccagcctctccatctaccacgccaggaacaggcatttactaactctcatggaagctcatttcattgtgaacatagtttcctttggtggaaaattattttctcttaacacggctttgccttcaagagtgaactgaaatgacccaacaatcccattcctaaggatatacccaagaaaattaaaaacttaggtttgcacaaaaacttagatataaatgttcatagcaacattattcatgatagcaaaaacgtagaatcaacccaaatgtctatcaattgataaatggattaaaagaagatctgtccatacaatggaatatttagtcacaaaaaggaatgaagtactgttacatactacccatgaatgaatctcaaaaacattatgcggaacgaagaaagcatttcttcatccagtcccaaaagaccacctcttatatgattccattgacatgaaatgtctaggataggcaaatttatagaaacagaaagttgatcagtggtttccaggggcactagaaagaggaaggaatatagagttactgatgatgggtatgagatttccttttggggtgatcaaaatgttctagaattagataattgtgattgttgtacaactttgtgaatataataagaaccactgaattgaacactttaaatggtgaattttatgacatatgaactatatcacaataaaaaataatttagataaagtaatccttcattctgggtttgaaagaaaggattaaaccaaacagatctacagatatttgaagctggctggtttgtctctaatgcattctcttctctaagataaacagtgctgattccttcaaccatctctcttatgatgtgaaattgagtcctggtctgaactgatttctttcttccccaaatgtcccaggttgacaatgctattcttgtgattcccctccctgagccaaaacactgctccaagtacagtcccattgggttggagtagaacagaatctacctttaccttcatgatgtcatgatatgatcacccaatgtcattgccattcatggattggacattttcattttgggatgattatagtccatgatttttttttccctgataaacataaaaagcgtagattttgttttctttaggagaagataatttgagtactgcactgaaaattttaaaaaattcaaaaagaacaaactgttacactatttggtagattgcaaaaatagctacaattctcaactcttccataatgcatgcccttgctcatgtgactttgaagctccttccatcaagaggtaaagctgtgtacctatctcttgaatctaggctgggcttgtgatttgtttgtgcaaaagaatgtgacatatgtgatgttgtgccagttttgagcataagcttcaagaaatcttcatgctctaggtagctgtgctgcccagttggtgtgggaacaaattcaagcttgcctgctggagaatgagatacaggctatccagttgccccattgtgccagttgatggccagccaacacgccacagcagatcctctaagctgactagtcattagccacagatgcatgagggaccccatcggagaccagaagaaccacccagtttaaaccaggccaaattgtcaacccacagaaatatgagctaaacaaatgattgttgttttaggccttaggttttgggaatgttaattatgcaacaaaacctaaatgaggtgttccacttctggctaggatgtagggagatatgaaggacctttatcccccaaaacacaaccacaaatcactaggcaaacaataacaactaaatcatacttaaaaaaaaaaagccctcaaagagctatggacgtaaagaaatctaaaaggacaacttcagagggaggagctaccactagacacagtgtttagcatgaagtacaggtataccttggaggcattgtgagttccgttccagaccactgcgataaagcaaatggcacaactagtcacacaaatattttcggtttcccagtgcatataaaagttatgtttgcattaaattgtagtttattaagtgtacaatagcattatgtctaaaaatgtgtataacttaatttaaaatactttattattaaacattctaacaatcatctgagccttcagtgcgctctaaaagttttgctgatgaagattattgcctcaacgttgatgactgctgactgattggggtaggagttgctgaaggctgaggtagctgtggaaatttttcaaagtaacatgatgaagtttgccatatgaattgactcttccattcacagcagcatgcaatgctgtctgataacatattacctacagtagaacctctttcaaaattagagtgaattagagtaatgccacagctttaacagctaagtttatgtaatattctaaatcctttgttgtcatcttgacagtgttcacagtatcttcaccaggattagattccacctcaagaaaccagtctttgctcattcatagaaagcaactcctcaactgttaagttttatcatgaaattgcagtaattcagtcatgtcttcagtcttcacttttttttttttttaaagacagagttttgctcttgttccccaggctggagtgcagtggcacaatctaggctcactgcaacctctgcctcccaggttcaagtgattcccctgcctcagcctcccaagtagctgggattacaggtgcccaccaccacacccagcttttttttttttttttttttttgtatttctgtatttttagtggagatggggtttcaccatgttggccaggctggtcttgaactgctgacctcaggtgatccacctgcctcagccttcctaagtgctaggattacaggcgtaagcctccgtgcctggtggaggctccacttctaattctcttactatttctaccacatctgcggttctttcctccactgaagtcttaaaccttttaacatcatctatgagggttggaatcaactttctttctttctttctttctttctttctttctttcttgctttcttgctttcttgctttcttgctttcttgctttcttgctttcttgctttcttgctttcttgctttcttgctttcttctttctttctttctttctttctttctttctttctttctttcttttctttctttctttctttctttttctttctctctttctctttctctcttttctttcctttctctcctttctttctttttgagacagggtcttgctctgttgcccaggctgaagtgcagtggcctgatctcagctaactgcaacctctgcctcctgagttcaggtgatcctcctgcctctgcctcctgagtagctgggactacaggcacatgccaccacactcagctaatttttgtatttttagtagagacggcgttttaccatgttggccaggctggtctcgaactcctgacctcaagtgatctgcctgcctcggcctcccaaagtgttggaattacaggtgtgagccatgacaccagaatcaacttctttcaaactcttgttaatgttgttattttgacctccttccatgaacaatggatgttcttaatggcaactagaatggtgaatccattccagaaggttttcagtttgctttgttcaaatctgtcagaggaatcactatgtatgacagctatagccttctacaacatatttcttaaataataagacttgaagtattactccttgatggctgtagaatagatgttgtgttagcagacctgagaacaatattaatctccgtatacatcctcatcagaactgatgggtaactagatgcattgtaaatgagcagtaatgttttgcaggaaatctatttttccaagcagtaggccttaacagtgggcttaaaatactcagtaaactgtgatataaacagatgtgctatctttcaggctttgttattccgttatagagcacagacagaatagagttagcataattcttaagggttctaggattttcagaatgatccataaaattgacttcaacttaaagtcaccagccgcattagtctctaacaagagagtcagcctatactttgaagctttgcagccaggcattgacttctccttagctataaaagtcctagatggcatcttcttctaatagttgttttgtctacttggaaaatgtgttgttcagtgccactgtcatcagttatcttagctagatcttctggatgacttgctgcagcctctgcatcagcactttctgctttaccttgcacttttatatcatggagactgagtgtctttccttaatcctcatgaaccaacctctgctagctttaagcttttcttctgtagattcctcacctctctcagccttcacagaattgaagaggtaaggcttgctctggatgaggctttggcttaagggagtgttgtagcttcctggagcttctatccagactactccaactttctgtatatcagcaataaaaatgtttagctttcttatcatttatgtgttcactgaagcagcacttttattattctccaagaactattcctttgcattgacaagttggctaactgtttggcagaagagatctagcagcaccaagacttgaagacaggtctatagagcttcaaactgaagcaacagaaggaaaaaagaaaaatgaaagtttaacagaacttcaaaggcagtgttaaatggtgaagcaaactttttttcagagtgtctgttggagagaatgacagataaatatgtgaaaaaatatggactgaaattttcaaaattggatcaaaaatagtaacccattgctataagaaaagctcagagagccccaagtaggataaaaagaaaaaaacaaaacctgaaacaaaactacattatagtcaagttgacaaaaagaaaagctaaggagaaaatgttaaaatcagctagaggagaaatcaatgcacattggatacacaggggaacaatataagaatggaaactgacttctcattggatacaatggagaccaaagacaatggaatatctttagtctccattgaattttttttttttttttactttttaaagaattgaaagaaaataaaaaaatctcaacatagaattctgcatccagcattaatatacttaataatgaagtcaaattaaagacatttttaaatgaggaagagttgaaagaatgttttgccagcatatttgcactgcaggaaatgctgaaagatgttcttcaagctaaggggaaatgataacagaagggaacccaggtctacaataaaaactgaagaccctgagaaagcataactatttaggcaagccaaaaatctaattttagaaattatttttttaatgcatatccatcatatagttaaactataaaagactactggatgtttaatgcaaaaataataattatgtagaatctctaatgtaagtggaagaaaaggatatgtgaaaatagcacaaaggatgaaaacggataaattatgctatcgtaagagtgccccattgtgcatgaaatgccatagtattattttaagttagaccgtgataagttaaccttacatattagagtgtactgcttaatagagtatctactggccatctgtggcaattaagcccttgaaatgtggctggtgatactgaggaagtacatttataattttaattaatttaaatttatgttaaaaactgacacagtgtaactatcctctgttgaaacacaatgtggttgctctggtaggcctatctttaactttaactgttgtgatatgctgtaggtataaaatttatgtcaaattgcaaagacaatgtaaatgtacttttagaagacaaaatatctcattaatacttttatatttgttacatattgaaatgataatattttgggtatattgggttaaatgaaatacattatcaaattaatatcatctgttttttaaactttgctaggaagtttagatattctgtaaatatatatatgtgggtcacattgtaattaggcagcattgctctagaggattactaaaattatagcatgaaatgatataactaaatagtcaaataaaggagagaaattggaatgctaaaaaatacccattttttccaaaataatggaggaaaaaaggaacaaaggaacagttggaataaacggagtaaatgaaattaatggaaaacaaatacccaaatgatgaacttaaacataattttaccacaagctgcatgaaatataaataaataaaatacttcattttgtcagattggataaaatgtgagactaaccagtatgccattcgtgagagaaacagtttaaagacacagaattaaggcaacaggatggaagatgattgtattagtctgttttcacactgctataacgaaatacctgagactgggtaatttataaggaaaagaagtttaatcaactcacagttctatatggctggggaggcctcaggaaacttacagtcatgacagaagtggaagaaaacatgtccttcttcacaaggtggaaggggagagaagcgcagagtgaaggggaaagagccccttataaaaccatcagatctcatgagaactcactcactatcaggagaacagcatgggggaaaccaccctgctgatccaatcacctcctacaaggctcctcccccaacatgtagagactacaattcgaattacaattcaagatgaaatttgggtgaggacacagccagttgatagcaagcttaagaaaactgatgtggttatatataaatagtagacaaaatagacatcaaaacagagaagaagtaacagaaataaagaagtgtacttcatattagtcagtttgtcaggaagataacacagttcccatatttgtaggcacgtagtaaaagagctacaaactacataaagcaacaaattatctaagtaaagtgatatatagaaaaatcccgaatcacactgggacctattatcattgtattttcagtaatttatagaaaagtagaataagtaaacttcacaaatgctgtaagagaagtgatgtagaatgaagagggatggaatttgcaaattgagatattctcagaggtcaccagccactatcattttaaaattctaaggacttattttgttagtgtaacttacattgttttagcttttgtgataattgcatattgatcttaagcttttatgatcagcaaatatttctaatttctttttccatgtgctctgttaaaccatatttgtaccaattatattggggaaaacagtttgaaaagaacaaattttgttattactatttgcagtttggattatatttttcctgattagtgtctgtgtacttaaatataagtatctagaaataatttataaatataattcctcaatacccttttaatgcttacagaatatcttagagatcttttaatgtgactatacaatgatgtatcgccattttattgtatctcctagtgtggatgctttataatttgcttagcaatttatctgtaattggatcattaggttatttctagattttcacagtaacaaacaatgttgcaatgaaaatgcgtttcgcacttttttacataggtatatgtatttttccctagggttgatcgcagcagagtggaatggtatatacaatttaaagtttcttacttatgcccaaattttttcacaaaactactttaaaaatttgtgctcctataaatagagtgcaagaacaacatcaaccttttcctaatcttacggtgatttgggacattttttcatgtatttgcaggctgtttgattgaatgcccttttctgtgaattacttgttcttatcctttgctcacttttctattgcattgcttgcctttttcttattcatttgagggagatttttaaatgtgcatttgataatcaacctttgttgtatgcatgaggaatattttctccatgcctgtttcttgtccttaacatatttattagaaatttcatgttggtagtgtcgtcgttgccctgtatcttttcagctttgtctcccgtgactgctcatgggattttctgagcacttgcgtgtagaaggtgctcagaaagcaaatggctttctctgggcatccccttgcttctttgcaccatgtgttaaaggcaaatgttggctgagttgagtcagtgtttctgcatttagtgatgttttaattagagcaattggcttgactcaagcctgttgacatctgctgattgctggctggtcagtaacatttaccatagaaagtgatggccatggatccccttccctcctctgggaggggtggatgcccagtctttccagctctgtgtggcatcctcaagctctgacagttgttggctccatgcagtcctcactaactagagactcgggttcatctgcctgttctaccccacatggatccctttaaaagagagtgaccatcagaacttggcaccttgggataccaattttagcttttggcagaagtctcagaaagtcttagtctttaaaactaagtggtcttcttggaaagatctcaaacttggccctgttggacactgcagacacatacaaaacaactgtttgttcaaacagaaaatggggaaacattacagaatctgaaatatgccgctatttaatttctaaaatatttttatatacaataaattcatgaacacatgctcatgttaaaaggtaacaccagaatgaaaaagaagtctcatgccattcttgcctcatcaagcctatgcctctctccagatgtaaccacaggtcaaagtcaggtcgcatctttctagacacaagtgctctttaaacagtgctcatgttatacctattgttctgtagcttcatgcttcacacttctttcatgtggtctttcataagtgacttacatttccatgcattagacctttcccttgccatctggggatgggtttagtcagagggacaggccagtcacaggtgtcacatactatagtgtgtgcaatgtggagggaagcaggggatggcaagagatatataacctttggctgagaagagaagtgggacagtgaggacctcctcgagcaactgacatatgggtgatccctgacagacatatgggaagtggttgtggtaggctgatcacgggttccacaaaagatacccaggtgctaacccctcagaacttgtgaatgttaccgtatatggcaagaagggcttgcagttgtgattaaataaggatcttgagatggggaggttatcctggattacctacatgcaatcacaagtgtccttataagaagaagaagggagatttgagataaaagaagggaatgtgaccactgaagcaaaatgcttggctactttgaagatggaggaagggaccaggagccaaggaatgcaaaggatgctgctctaaaatttggaaaaggcaaaaaagaaaaagaaagaaagagagaaagggaggaagggaggaaggaagggaggaaggaaggaaggaaggagtcttcgagcttctggcgagaacacagccctgccaacaccttcgtttcagcccggtgaaaccagttcttccagaactgtaagaaaatacgtaaatacacaagccatcacatttgttgtcactggctagagtggcttggaaactaataatagccaagtagagaaattcatttaaaagaataatcctgtaagttttctggtaagagaacaggaactactctttaacacgtgttggagcaaagtgagggataaagcaaagagactgtagactggcgatgtaaacaggggccagatcacacagagcctgcagggcacacccagcaggtttatcttctattgacagcaacagggagcaagagaaggcttttgagcaggggaacaagcagactgtagtattggggagatcaccagtagactctccttgaggctgttacaaaagaagaaacagaatttggtcacctagatggcaactcttggttttcctactttttttttgtttgtttgttttttttttttttttgagacagagtcttaatgtgtcaccctggctggagtgcagtggtgcgatctcggctcactgcaacacctgcctcccaggctcaagcgattctcatgcctcagcctcctgagtagctgagactacaggtgcatgccaccaggcctagctaatgtgtgtgtgtgtgtgtgtgtgtgtgtgtgtgtgtgtgtgtatgtgttgtgtgtgtgtgtatttttagtagagatggggttttgccacattgcccaggctgatctcgaactcctgagctcagggcagtctgcctgcctcagcctcccaaggtattaggattacaggtgtgagccattgtgcttggcccattttcctacctttttactcccattgcattaaacgtttccccattccatccaaaactgagttccctctccatcctaaaaagaactgagctctgctgggcacggtggctcacgcctgcaatcccagcactttgggaggccgagatgggcggatcacgaggtcaggagtatgagaccagcctggccaacatgatgcaaccccatctccactaaaaatacaaaaattagctgggtgtggtggtggacacctgtagtctcagctacttgggaggctgaggcaggagaattgcttgaacccaggaggcagaggttgcagtgagctgagatcatgccattgcactccagcctgggcgacagggcgagactccatctcaaaaacaacaacaacaaaaaacaacaaaaaaaccccagctctcctgggataaaactagataactagtttcaaggctgtgggtaggtcattcctttttgggtttccagggtggctgtttgagtagtagtaaaaagagggagctttctgagctggctgtggaccaaagcaggctagaaagaggcaacagagttgaaagcactttacttcatctaatctagacccatgatgtccctgagccagctgctgactgaggacaagggggtagagagacatgtccccattcccaaggcccagaggatggcagtctatcactggtgctcagactccctttcagggctggagtcctgaatagaaaaagcactccaggtatcactgttctgtaagaattgtagttttgcccctaggaaatttctgaatctctataatgattaaagcagacagtcaccaaatcactctgtaggggagaaagataaagatagccttcagggttaggtaaaataataaaaatacacttgagtgggaggcctgtcaaggtgataggagattttctgttctcactttaacagtagctgttgacaagaggaggcaggactgtgggacatgggaggctttctattattggggctgctctctcaaaaggaggtgggagtcaccatgagtcagcagggctgttattgtggtgacagagtcaatgggtttcctatgcctttgaagtcctccatcccatttatccttggaccaacacatcctacctaagaagtcatcaagagcattgctgaacagagaccaccacgctgcgtctactccagagagcaatagctcagtagacatgggtgtttatgattactgtagtagccatcaattcattctgcctatatagaatcatcctcccattccccacccccacccaataatagcacactgtgttttcctgcagattcacctcttccccactctcaatgtgtatgacttggtggttggcctccacctctagattttactgtggaactgagactaaagccagggccactggagtatgctatcactgaagcttagagatttcttcaagcattggcaagtgacttgaggtgatccaaacaggaccatgtacagcttttgctgcaacttacggaaaataagcacactgctctttggggagtactgaaaggacaggatgtacattcggagcagctgctggccatcttgccccaacaaggagagagcctggctgagactagaaccaagatccaagaaagattaatgaagacgtgaagatctagattttggatgaatcccatctaaacacctggatctaactatgcctgaagcttgatactcccagtaatctctattttgtttaagtcaatttgagttgaatttccttcccctgcaattgtaggagactgcttgcacatctatcatcacaccattgcaattagtagctttcatttagtgagtagttactatgtttgcagtctttactaagcaaaaatctttttaaaaatcctttttatcctttacaaaaaaagataaactagagaatgtcaagatttggagggactgtaagagcatctagtccagcggttcttacacaagacctatggacccctgaataatctctgcacatttcagggccttttagcctctggctttttatgcaagaccacgagcactggattttttcctgtttagagggcccataacccttatcagatcctcaatggtttgtgttcctagaacctcttcttctataccacacagaatctttcccactgtcataagaaggtcacattccagttcctgctccttcactgagggaccctggggtatttacttgctgcttcttaaaatcaagcacagggctgtatggaattgagtttatgattcccacaaagattttacaaaaggaagggacttcaagtcaatttctcctttgtggtggccgctttggtctttgcttctgatagttgcttccaccccaacttttctgaacctcagtttcctccaccaaaaaaagagatttaagatgatagccctgcctgatttacagagggtcatggggatgagctgagggcaggactgtgaaatgccctggggctttagcctggtgtcctggccccatctctgccttctgtctaccttgcaaggtgcttgctgcttctgggctggtccgtgagtctgagatgtcggcttgttttccatgttctccagcagcattgctgacatcctgactggcttatgtataccagagcctgttcatcaagctggcatatgtagttcttaacaaacacattaaggaaacattcggaatgtcacttgcagagcaaatgaacagaaatagacgggccatctgatacagagaggtattttcttagctggcagattttatttcccctcacacgaggttgaggcctctagaatgagtttgttcattaatgcatttactcagttacgcatttgaatgaatactgaggagctactctgctcagcactgtgataggtgctgggaggacagcagggtgtgaatgacaaacagtggcatattcttatcctcaaggtgttcaccttccagtgatggggagagacattcaaagcaagattgcagtccactctggtgggtgatgaggcacagttcagaaaagtgtggccggaagacagaagaggaaactgactgtattctagggggacagctgggcaggcttcagagaggaggagacatttgatctaggttttgaaggttgagggagagcttgtcaggcagaacaggcggtgctacctctagcgaatgtatttgagtcacacagcccccaagtatgttagcagcggcgaattcctgtgggtctgcagcaacctcagttctagactcttcagaaagaaagaaacagaggcaaggtttagagcaggagtaaaagtttatcaaaaagttttaaagcatagagcgggtgtggtggctcatgccagtaatcccagcactttgggaggctgaggcaggcagatcacctgaggtcacgagttggagaccaccctggccaacatggtgaaacctcatctctactacaaatacaaacttagccgagcatggtggcgagtgcctataatcccagcttctcgggagtctgaggcaggagaattgcttgaacccaggaggaggaggttgcagtgagctgagattgtaccactgcactccagcctgggcaacaagagcagaacttcatctaaaataaataaataaataaataaataaataaataaataaataaataattaaataaaagttttaaagcgggagcaaaaggaagtacatgtagaagagggtcaagtgggcaatttgagagattcaagtgcatgatttgacattgactttgggttttatacattggcatgcttctgggaggtcgcatcccttctccccggagttttcccttggggtgggctgtctgcatgcacagtggcctgctagtgcttgggaggggcctcgtgcacagtgtgtttcccgaagttgtgcacatgctcacttgaggcattttccccttactagttgagtgttccaagaggaaggtcatatgccatttaaactctgtcattttgcctcttagtgctcatgcttgagccgactcactcaactgctgagatcttatctggaagctgctaatcaccagtttcaagggttttctatctattgggagactgccttaccctggcactggcggcaactgatatttattttagagacaatttaacaaccacttgcccatcacctaatggtggcctgacattcctggtgggggtggtggtggtaggggactttcctaccctgctcgtgtctgactagctacctactgtaacagtgggagagtctgtctgggaaagaggaggcgtgcacatgagctgtagtgctgtaaaggtgcaatggagtcagaggcttgcagggctgggtacctgtggtgccgcaggggaatggaccaaggtagagttgggaggtggctgggtgctggtggcccaggactgtaatatgcctcctggagtggttcctgcattctctgggcccatggtatttttttttttttcccaagcaggcaagtgatatgcttaaatgtgttttaagggaaagtgtggtgtggagtgggagggtggggggtttgggggtggaaatattggatgtagaagcaaaaaagaatgaagaaatccaacatgtccctaaagcagtggctgtcaaccctgcatgatagagtcaccaggagaccatttaagaagacctgtttgtgacctcccttcatgcctgttgaatcacaagggttctggcggtggtattaagttcaagtgattgggataagcagtcaaggttgagaaccactgctctagggcttcttggatacactcacggggctgtgttgaatacagattactgggcacctggactagagaggctgaatgaatgggcctctgatttttaaaaataaactttaaattttagaacagttttagatttacagaaaaattgcaaagatagtgcagtttccataggcctcaccttcggtttccccagttactaacttatgttgttactgtaccctggtacatttgtcacaatgaacaaaccaatatcaatgattattaactaaagttcatgctttattcagattgccttagtttttacctagcgtccttttgctgtaccgggatcctgtccaggacactgcatcacaggtagttgtcacatctccttggctgtgactgtttctcagacttgccttgatcttgatgaccttccccattttgaggagttttgaggagttattttgaagaatgtctcacaatggaaatgtgtctgatgtttttctcatgattaggctggtgttatggacttttgttaggaaaaccacagaagtaaatgccattctcatcacgtgatatcaagggcacatactgtcaacatgatatatcactgttgatgttgactttgatcacctggctgaggtagtgttcgttgtttcttcactgcacagttattcttttgtacttcttttctctactatttgaaagaaattcactatctgtagcccacactgaaagaataggagttatgctctacttcctgaagggtggagtagatatgtaaattatttggaattcttctgtatcaaaagtttgtctattctcccctatttatttatttgtttaatcatttatttatattgatatggacacatggctattatgttattttatttttaattaatttttaactttttatttatttttaacttttgggtaatatcaatactatttggttgctgaaaatgttttggctttggccattgggagcactttcagttcactctgtatctccttaacgtaaccctgttactgtgggattgttgtattagtctgttctcatgctgctaataaagacatacctgagactgggtaatttataaaagaaagacgtttagttgactcacagttcagcttggctggggaggcctcaggaaacttacaatcatggtggaaggggaagcaaacacatccttcttcacgtggcagcagcaaggagaagtgccaagcaaaagggggaaaagcctgttataaaaaccatcagatctcatgagaactcactcactgtcatgagaacagcatgagggtaactgcccccatgattcaattaactcctacccggtccctactatgacacgtagggattatgggaactacaattcaagatgaaatgtgggtaggggcacagccaaaccatgtcactcattttatttattttttctcagtacttccttactttctggaactacaatgagctcaggctcattttgtatacttcctgctcccattctagaatccttgtattggaaatcatcctggtattagaaatcatcatctgggtgctaggtgtgctcattgctactggagtattgttgcttttaataggtctacattttgtaagatttaatgtttaatcaactttgtggaggtatacttcacatacagtaaaacacacctattttaagtgtaccttttcatgagttttgacaaatttataaagccacgttgccaccattacagtcaagttggaacacgttcccacattcttgtgccacttcccattcgctctccacaccactctccctgcccaggcaaatactgatgtgttttctgtcactttagattaaagttgtcttttctagagtttcacgtgaccggaaacatacggtatgtacttttatgtctggcttctttgactcaccaaaatgtttttgagattcacacatattgtgtgtatcagtttgtcactttttttattgctgaatgatactcttttgtatggatataccaaactttgtttatccattcacctgttgatggacatttaggtattttctattctttaactattaagaataaacagacttcatttcaaccagcattcccagtgactctgatgttaagggtctaaggaactcctattgagaacagttttaatgttattttggaggagaatcccttctgatacatctcattttatcacacctgttttgctagcttaggttcttccttaaacctggattacatactgagaagatatagctttcgtcttctgttaacccatctgtgatttaggtggtttcatctgacctcttgctgggtctgagactctgcagtctgagatgtcagactgcagaaactttgacagagactgcggtcagcctttgaaacttcatatttcttccaagttccttgagtgtgctctctgtgcttgagactatgtctttagattctccaactagcttgagaatttcctttgtacttttctttctttctttccccctcctgtgaaagaaatcctgtcaaactaaagttacattttctttttcagagacagtgggcacaggcatatactccccttttgtggcacatgttttattactgaactcagagggaaaataaaccactttacgttttaacattagagaacagaaaagttataagagcaacaaaagatgcctgaattcttgtcttgttcatcgtccatcccattttctcattttcttcctgtttctttccatggtccttcaccacttctgtacattaacaccatataagccatggtaaaacataacctctaaatatcaaagtttatttctcactcatgtcaagctccaatgaaagttttcctggttgagcaactttcttccaagtggtgattcaagggctccggctccttctgtcttgtggttctgctatcttccctaccttggtgattcccaagttgccgtgggggcactctttgttcaagactgccagaaagggggaaaagcatggagcagccatgcaggaagtttctatgggccaggcctggaagcagctcatgtcacttctggccatactccatgagcccgaactcagtcctgtgcccaaccctcactgctctgtgcctaatggaaggctctctgcccaagaggaaaagaaaacactgcccacaattatggtgatgattctatttgattcttacccttggggctctcactaagcacctgtgcaacacacggttgggcggctgagcattttcttgagtattttgtcagatcttgggatcaacccttgcctccagttcctttagggaaatatcacaaaaaaagagtcattgaaatgttagctttgtaggataacagtcttgtcttctttagtctctattgaatccctaatatatagcacagttcatggcattacatgggtgctcaataaacatttgttaaacggatttttagaaaataaacatgagttggccgggcgctgtggctcacgcctgtaatcccagcactttgggaggccgaggcgggcggatcataaggtcaggagatcaagaccgtcctggctaacacggtgaaaccccgtctctactaaaaatacaaaaaattagccgggcgaggtggcgggcgcctgtagtcccagctactcgggaggctgaggcaggagaatggtgtgaaccccggggggcggagtgtgcagtgagccgagatcgcgccactgcactccagcctgggcgacagcgagactccatctcaaaaaaaaaaaaaaaaaaaaaaaaaagaaaataaacatgagttaaagttttgtcttgacttgctccccctggatcatgtgtagactaccagcaggtggcagagtggtttgaaatgtgcatgctggagcagggtggaggaactggctggtgtcccagctccagctgggctgtgagtgccaggtctggggtcatagactcaagaggcagtatgagtgtgacagagtagcatccctggacattgaccacatacaggatctcccaactctaaagttggaaggattgctatgcttattctgcagatgaggacactgattcatggagctgttaaataacttgccaaaggtcaccaaagtgagtagctagaaaagggcagagtcaggatttgaacctgggtagtgtgacttggaagcttatggctcttaaccatcatgctacaatgccaagaaggcagatagggaaattacccaccctggggaaaaaacctgtccatgtgcaggtcaaggtggctttcttgggcatcaagagaccaggcagggagcctgggaacacaaggctgagggcatagccacagagcgggccagtccttccgatgaggcacctggtggagggtctgagggtagaggagaggcctccagctggcttggcatcaggcactacaaggagggcagcggtaccaggcagggacagattcatggatgtgtgttggagggacagccacaaatggctggagttgggaacataccagaaatgctgagaaggagatttcagccctgtgaaagggttggctcatagtttccaaaccacaccggcaaaactctgggttttcacaaagacacttgggtggcctcttgggttgatggggagagagagtggggagggtcctgagcccttctctccaataccagccagtatggtgctttctctccaacatcagccagtatggtgctttctctccaacatcagccagtatggtgctttctctcttttatatattgggattctgcataagtgtttattttaaaaaacaagtctctcctttgaaaaccattcagctaaatggcttccagagtccttcttttgatgtctgaagtggaaatggtattggaagctctcctgacataaagacagtgcactccatgagccgacttgagtccacttagggtgacttaggatgaagcatggttttgcacctgctctctccacccttacctgccctgtcccatgctcctcctcctccatcacgtggaagggaaatggccatgactggcccagacagagggcagtttgtgcagcatctcagaaactctctggtttgaaccatgcagccttgtttccatcccagcctgggccccacactggccctgcaggaaagtttgcctggctcattatctgaaagaaatggcctgagcagtagcctgccaagaatggggggagaaaggagaaatagtaacattgatttatttgggatggaaagatccacagactggggaaaaaggtagagagcaatcataaaactggctcagttctgcaacctgctgtgagcagagactgtcacagtgcataatagcaaaggcagatgaaatggacacagggagtgcaaccccttcctccctatcacagaacaataaagctagaagtcaaggatgaaataggtgggctgaccaatagtacattggccaattgaaggcctggcatctaccttcgaaaggctgcctgtgttgggattgatgtgctcactgtgactgcagtgctctgcaggaactgtttgataacaaacagggtggcagacaggcttgtcccttcatattaaccccatcgctcagctgtcatctcagtcaatgccccaaactgcccaatgcccacctcaccttcttctcctgaggggccacctgggctggaaggggtggagctcaccagctgggactcctgggtggcatctgtctccaggaccaggtcatcttaggacagctctgggaccccacagacccagtgggtatgacgtgagaagtcacatgaaggagatccctcacaaccaagtccatttggggactcacagaccccatagcccattttttcaagtaccagtcctgcaagttgcggcaaatcggagcagggagaggcactttgcttttcctttaagggttggagagatttttagcatacaaattgaagcatctccccaagcagtgctttctctaaggctgaaggacaagcagggatggcatgagttttgcttccccaactgttcccaggcacagcaggcctgcaggtggcagagaaacagcactcacatagaatagtctaaaatattttccaccaaaaacctcatgcctgatgatttgtgtttgagccacattcagtgacctggacagagttgatacccagacctgggttgcatttgtcctatgggaaatgaggcctgagtacaacataactgaaaaatccaggagttggaaggtgtggggagtatacggtcatgtgacctggtcttggttctggatgatcactttgtgctgggacccagttgtttcctctaatcttgggaacctggagagtcctgatcattttccacactgattggggttcagggaaacacttgaagcctaggggttggttaagacccactagaatgtctggattcctagcccagctctgaccttctagaagtatgcccgtgggcacatcccttaactctttcagaccttggtttccctatttgtcaagagtgaatgatgctgatatgacatgggatgttttccatttattcctccagattcattctctatccttgtccatccatctttgtgtataggaggctgacttataggctgtagcaatgggcttccttatcctgtggtgtccaaatgggtttgtcaatggaagttgtcagaagaaaactgaagaaagggaagagagttaggtcgaggtatttgtttcccatttcctttcttccgggtcactgtgagttggttgcatcccttttctttggatggttctccattcaggtgccggtccccatccgtctacttgcaagctctttcaaacccaaaggagtgatgacttcctgctgtcactagctgtggagtactgcaccagcacctgttagttcctggggcactgcgtatacctttgtaaactccctttattaagctttcatcactggcctcatttgaatgggccatctttgttctgccaggaccctgacttgtatattacagaaacctctttcattcatacctatgtcacagagtggctgtgatgattacatgagttcatgcacacagaaagcttaagacagggcttaacacataggatgggtttgttaaatgttagctacctctgactcttaattcttgtgtcattatactgccccagacgaggacacactttggatgatttagggacttgacgttatggccatttggttgttctgtctcgtttctgatagttccctgttctttcctccgtgaaatgtgggttgatggaggtgtcagcatgtggccttctgcgcccacccacctccttctcacaccatccttaactccagctttttcctatggccgttttgagccctgtgccatggccttgtctactcctgaggcccaacacaaagagatatggagcataacctgtatttgctggtgacacacaagtctaaagatgtcaccacaatctacttatagcacccaaagagatttctcatgcctacttgcaatcacttcgtatctgtcccaactccctagccctggcaattgctggttaactgtctgtatctatagattttcctcttctgtgcattatttataaatggaatcataacatatgtggtctttttgtgactggcttttttcactcagcataattttttcaaggtttattcatgttgtgccatgtatcaacacttggtttctttttatggtggaatactattccattgtgtggatagaccacagtttatctctctgtcttctgttgacggacatttggattgtttccattatttaggtattatgaacaaagctgctctgagcatttgaatatatcacataggttgtttatttgtgtgattcatttaattagaatttaagcttgatgaaagtagtttattatatgtcatatattgtattatatatatgtttgccatatatgattgataagtgttttttaaatgaaagaagacataaatagtggcaatggaaagaaatcaaggtggttagaaatcctctaactggtttagctgggaaatccaggctggtagaaaagacatcttaagggggtcctggcaggtctgcattggcatcacctgaggcacagggccagggaatctgcattttagcaagcttcccagggaattctgagcaccctggagctggggaagccaggaatattttgccagttggagaagcctgcctgtgagtggtagaatgaggtaaagttgtggatttgtccctgcccaaacatttcacttttacaactttgtttatgagagcgatggagttgtgttcctttcctagtgatggtcccatgtgggacatctctgtctaggtcaggttaaggctgaatcattttccaaaagtaacttcagttttcttcttttgtccttggtgctgactctctcacaactcatctgaggggtacaggttttcctttgctaggggggatgctggatgattgaagaggcaaataaagcagcttgcagtcaactcagcaagaaggaggtccagagccacagacaggaccacaaagagtcacagcgccttgagtagggtaagcagcaggttaagtgtgcaagggttaggagtctggattaggaggaagcagctaacaggtacccctgtagaggcattgaaaagcagcatttctatattccatcatccaggcaggctcataattctgcctttcttatactgaaccagatatactgttagcttgctttgcagctgtgcagagatatacatgactgcctttgctggaagaagttgctgctggttttttaagggaaggtttgctctttactttgatctgacttctaaagaataaagcatattcttttttatagcaaaggagacttctaggaagtttgagtaccgtatttaaatttaaagtctcccctcagcatgtgaaggcaatattagtgtcagttaggtgtaacagatgaatggttaacgtaacaaaagatggaaaacctgaaaaagattcatatccaaatgaaaatgcatgtttgagctaaattactgctttttgttgctacttactttttatttgataatgagcattagctacatatgaacactgatagtctctttaggataaataagatgcatttccacctgataatgggtgtaaattcagcaacgtgcttagcccatttctctccttcaggatcctgaaacagaatgagggagatagcatgttcttacatattcaatagacaaagttaaatggtctgcctttctccccttattttacacattttatcccacattagcacctatattataagaatttgctaaattaaaatgtatatatcatttattgggtactctactctgtatcaggtactatatagctctttatatagaatattttatgtgatcctcatcacagtcctatgagataggtactatctttattcttattttacagagggagaggaaactgaggctcaaaatggtcaggcgacttatccaaggttattcagttagcctgtggaagaattttgattcatgctaccctgtgcctgaaaccaaagccaaaattcttaactactgatttgattccagaagtactagaactgtggtctgcagaacccatggggggtgggggtggggagttcctgagaccctttcagagtgggcctattaagtcaaaacttttttcatgataatataaattcattatttgtctcttcatctgtgtggatacttgtattggtggtgtaaaagcaaaactgattaaatggctgtcacttttgcacaaatcaaagcaatggtacccaactgcattgcaaatcactgactcttttcctacagtgtactcacaaaaaactgcctgatgttaaaatatttagtgttatataatggaacgtctcaacatttggaacagctgcataactcattgagccaatagctttttaatgaccaatgcatggtgtaacaaaatcatgcgtgggtaaagagccacttaaagtttatgattgttctttttaaatgcatacatatttttaaatttctcagttctaatggcagatattggtagatataacctgtataaacaaaacctatgtaggagtggggatctctctctctctctctctctctctctctctctctctctctctctatatatatatatatatatttttttttttttttttttttttttttttagacggagtcttgtgctatcacccaggctggagagcagtggcgtgatctcggctcactgcaagttctgcctccctggttcacgccattctcctgcgtcagccttccaagtagctgggactacaggtgcccaccaccacgcctgcctaattttttttttttttttttttttttgtatttttagtagagacggggtttcaccgtgttagccaggctggtctcgatctgaccttgtgatctgcccgcctcagcctcccagagtgctgggattacaggagtgagccactgcgcctggcctaatattttttaagattgcaaaagagtgtggaggccaaaatgtttgtggagcactgcaatgggcagctgggaaccaccggaggctcttgagcagagagaggtgtattggtcacatttcttagagtaactcaattctgtgtccttttcatcatgggaagtttctctaaaaactccaccactgacatacttttgtttttgagacaggagcttactccgttgcctaggctgagtgcagtggcgctaccatggctcaccgcatactcagcctcctgagctcaagcaatcctttcgcctcagcctcctgaataactgggattaccaccacacactggctcattttttattttttgtagagacagggtctcactatgttgcccaggctggtcttggactcccagatacaagcgatcttcccatctcggcttcctaaagtgctgggattacaggcataagtcactgggcccacctatatacatattggcatatgagaatgataccagaatgaatccagaagactctcccagacttaagctctgggctttgagagttgccctatgtctggtgcttgaattgccctatggctggtgcttttacagctttgtttatgagagcattctgtgcatagcagtactcttccccaaagcatcaggctctgaatatctagttcctaaccaggctgactccaatcagataaagccatcactcctgcataggcctcattctctgaggatgtgcagttcacatctatgtagcagataaaaaattagacttacatgtacaggatcagactggggagaggttaatcacagtcaggccaacctcatggaagagagagggcatggaggccagatactcttgtgagatgggaagagaaaatttcctcactgaactcctagatagaataagaaaaattccagggactggacttgccaagatggacacattatctaaggctagtttttattaccaaatgcttataagtgcttattctctgttgtatactgtgttaaactcttttcttttctttctttttttttttttttttggggcaaagcctcgctttgtcacccaggctggagtgcagtggcgcgatctcggctcactgcaacctccgcctctcgggttcaagcagttctcctgcctcatcctcctgagtagctgggattacaggtgtacatcagcaaacccagctaatttttgtatttttagtagagacgggggtttcaccatattggccaggctggtcttgaactcccgatctcaagtgatccgcccaccttggcctcacaaagtgatcagattacaggcatgagccactacacctggcctgctaagcccttttcatgcattatctcatttgatctcctcaattgttctatcatgttggtaatattacatccattttacaggtgagaaaactggggcccagagaggtacaggcctgagccaggctttgaatttagtgttggtttcttcaaagcttccagttcttaactcctctgttgcattttcctctttaagtgtattggctggatggcagctggaaaacatgtgaaaaacataatgagagtagggaaaaggcataaaggcagaactgggagtactatggaagggactgaatatggattaggagggaagggagcgatcaagtttgctgttgcttctggtgtatgtgggttgttgagtgctttatgctggataggcagataataacctgaggccagtcctgttacttggctgctcttcaagatggaagaccattctatgaaaaccagaagaaatcaacacactaattattattattattattttaaatttcactttaagttctgggatacatgtgccgagtgtgcaggtttgttacataggtgtacatgtgccatggtggcttgctgcacctatcaacccatcatctaggttttaagccctgcatgcattagatatgtgtcctaatgctctccctccccttcctccaactccctgacaaacccttgtgtgtgatgttcccctccctgtgtccatgtgttcttattgttcgactcccactgatgagtgagaacatgtggtattttgttttgtgttcttgtgttagtttgctgaggataatggtttccaacttcatccatgtccctgcaaaagacatgaactcattcttttttatggcttcatagtattccaaggtgtatatgtgccacattttctttatccaatctatcattgatgggcatttgggttggttccaagtctttgctattataaatagtgctgcaataaacataagtgttcatgtgtctttatagtagaatgatttataatcctttttgtatatacctagtaatgggacttctgggccaaatggtatttctggttctagatcttgaggaatcaccacactgtcttccacaatgtttgaactaatttacactcccaccaacagtgtaaaagcattcctatttctccacatcttcgcctgcatctgttgtttccagactttttaatgatcgccattctaagtggcatgggatggtatctcattgtggttttgatttgcatttctctaatgaccagtgatgaagatattttttacacatatttgttggccgcataaatgtcttcttttgagaagtgtctgttcatatcctttgtgccctttttgatgaggttgtttgtttttttcttgtaaattttttttagttccttgtagattctggatattcgccctttgtcagatggatagattgcacaaattttccccccttctgtaggttgtctattcactccgatgatagtttcttttgctgtgcagaagctctttagtttaattagatcccatttatcaattttggcttttgttgcaattgatttcagtgttttagccataaagtctttgcccatgcctatgtactgaaaggtattggttaggttttcttctagggtttttatgtcaacatgctaattattatgtagccagaagtttggtggaaaacaagactttgtagtagagccagtcagtcagccacaggactcaggcgccgtgctgagaaggaggtcagacagtgctataccgcctgggaaacattagcggaagatcatgggctacaggcaaaagcgaatggggcttgagacttagctctaccccattgggttagcattgctctgttctcaacttcctgatctcaaggatggagatgataataccaccttgaagggctgttgtgagagttaaaagaggcggtataggaagccacatcacatggtgaccaaaacacaccatgaacattaatattttttcttctcttcctccccagtgtccaataaacacattctgcttgagctcttatctccaccccctctgcctttcctaggtaatatattttattcttgtctctaaagacaccatgtattgaatgctttggatatcgtttgggaaccagatggcttgggcttacctcatgctcattagctacatggttttgggcagggcacttgacttatgttgcattatttacttcaacagtaaagcaatagaacaatggcatctatctgtagggtacctgtgaagattaaatgggacaaaacatgtagcgggtagagcaaaaggcttaacacattgcacaagctcaacaattgttcttactcaaaagcaatgtcctcagagaagacattcaacccttcctccatcccctccctattggctaaaaatagggagcacagtgaagatctggcctatggcaaaccttggcaggtgcatgggagctgagctctggcaaagggcaggtccattctgttgtggaaggggtagagtgggggcagatagactgaaaggttgagaacattatctggttcctaaaaggcttaaagggttacctctggagggtgattgggagccctatgtccattaaacgcatacaacagctgaatgagacctcaagtttccaaaaaaagagttgtatatttttgctcatatcattacctacaagaatcccagaagagaaataggccttcttgtctacttggataggctcagcaagggtaaatggcttgagaacctgcagcaagtaaatagcatcagcagaactcaaactcaggcctttccctagtatgacactctccccatcacaccacaagccatccactgaccactagggtgatcgaaccagggctaggatgagggtgaggggaatgaggcgagccgtgcatgtgccagatggggacttgtctttgtttaacattttgatatcttgttcatcatggattttttccattctgatgttttaaaatcattgcattaaaatgttatttgccttgaaaaaataattattccttatcattattgtggtgaaaatttgacaagcattgtgttacgtgctttctaagtgccatgttgttgcatctttacaacaattctgtgggacaggatgagaaacctgggcttagagtatagaaaatcatcatgcagatataaggcgtcccaagattgcttttttctctgtctaccaccccacactgtaggcctctcttttgtttctaaccaatgctctttatgacttatttattggctatggcctgattaagtgacttgagaactggcgtaaggctgctatttatgtgcacattgataacccaccttacagtattgaagaccctacatgatcatcaacgttaaagggctcggaaaaacctggaagcactctacaaaatatttgttctttatttatgtaggtccccatcatgttctagaacgggatttgtagtagtctattagttgtcattagagtgatgatgattaatgattataataacaagacaagtgtaattggttcaaattgtgccttttgaaatagcctcctcggaggccaggcagccgggagggagaaggcagcctctgccacagggatctgaaaagatgggcctaattggttaaaagcaggattgctaattgctttggcaagggcctgagggaaggctctggtatgattatagatgaactgaggtcccttgaaaccctgtgattctgggctagatctgctcctccaaacacaagcagaaaagagagcagatgttcagccacttgacaaagatttaataagacacttagaaaaattaccatgttcactttgcccctcctgacccctcggttggaagctggaggaaggcctgttttgggcggctgatgctctgagctgaaaccttaagcggcatgtgccaaggagttttccatttttccacgatcctcctgttctgtggtcctcccctccatctgacaagaagggctttttgtgatgtgaggaggaggaaaggtagcaggaagaggagaggcttgatgatgatcgacatctgtgctttaaattccagttgagggtagacaggctgccactgagttattgaactcttctatttggagagcaaaggagtaaagtcaagccagatcacagcaccacacggcaaatctccacggcatgtgctggagaacccagcagggcagaagagcccaaaggtaggattttgccaaagagaaatttctcccttgtagattgtgttagtcaccaggaaaaaacagtacggagactggcaatgaggctgaatgggtgtgggactctgctctagtctggggaagcctgggaaaacttgtcggtggccacttgtagccacaggggtttggagagtgaccacctggattcaaagccagcccaacaattcattagtgaggggctcatgcaaatcacataaccacactgaatctcaatgtcctcacttgtaaaatagggaaaatgatacctccctcatacagttattgtgacaagtaaatgacacagagcaagtgtgttcattttctagggatgcaaatcaccacaaattgtgtggcttaaaacaatagaaatttggccaggtgtagtggatcatgcctgtaatcccaaaactttgggaggctgagacaggcagatcccaaggtcaggagtttgagatcagcctgactgacatggtgaaaccccgtctctactgaaaatacaaaaattagccaggtgtggtcgtgggcacctgtaatcccagctactgaggaggcctaggcaggagaatcatttgagcctgggaggtggaggttggagtgagctgagatcatgccattgcactgcagcctgggtgagagagcaagactccctctcaaaaaaaacaaaaaaaaacaaaaaaacaaaaaacaaacaaacaaaaaaacaaatcagaaatttattttctcacagttctggagaccaaaactctgaatgtaaggtgtgggcagggcagtgctgcctcgaggttctaggggaggatccctccttgcttcttccagcttctgatggctcccagcaagccttggcattccttggcttgtggcagcatcactcctatctctgcctccatcttcacatggtcttcttacctggatgtctgtgtcttctcttcttcttatagcaatgccagtctttgaatttaggggccatcctaaaatcctctatgatatcatctccatatccttaacttaaccgaatccacaaagactgtttccaaataaggccatattctgagtttctgggtgaacatgaatatttaggggacactattcaacacaccaccataagtaaagagattagaatgccccttggcacatagaaagctctagataaatgttagctactatgtttgctatcactactacttctgttgttatcacggcggaggtaccaggtcgtatttcctcaggctcacttgaaacacaattatttgttaactatatgtcatagtaggcacaaaggttaatcagatgggctaagatgaaggggtgatgattttaaatatacaagcatagcacactacaactataaaacttgtaggtcactcatattgggtttttaagctcctttgatgtcaggcattatttcttgctcttcttgcctgacattgagctgagaaaacaaggaattggcattgaactcacagagccttaagtttaaacactaaatctaccttacctctggaaactcatattttcttatctgtaaaatggacaattcttcctttagtcatggggttgctgtggatgttgaagttgaagccctagggcacggtgctgggttttagagggggtgtgtgggattcagcatcgctagggaaggaggacctgcatggtggcggggggagtgtggtggagccattaaccagcgttgggtcaggtctggatggaaaagagaagggaagtgacttcactcaaagcttaggggtggaaggttagagaaggtctgggatcaggtatgagagcaaccaaggagcaacaccaaattcagccaggcgaggacatggggcgggaatccacaagggagtccaaggtgaaggtggcaggggaactcctgtgtttctgacaaatgcttcaggtagtcatcagtggcacatggtgctgtggattaatttatccaggtccatacatacctgtgtggttcccatgggccaggtgcgtcactaagaattaggtattcacagtggaaagcaaaaactacagcctttgctctcttggagcctacagagtagactggaacagaggttatttttaaaaaaaattactgaaagatataaaaacaaagtgtgttcatcactgggtaagaacagcacagggagtagctatgagagatcagtgataaccagggttctgatctagtccaggagagggagaggctgaggaaggtctccctgaagaagagacatttacattgggagacaaaagaggagaagagattgagcaggtgcagggtgggctggtatagagggagggccgggcatgaaacagagggtaaggcaggtggaaaggtgagaggcaggggaggcttgcttggtggtcaggcagacttgggtagttgtggcagagaccgtttgacccacaagacctgaaatacttactgcctggacctttacaggaaaagtttgctgatctcttatcaagtgtgttttcgtaggtgtcagcatctttgaatacaaccgtgctgtttctgagtaacaatggggagggtgaggggatattgtcttctctctagctgcccccaaaacttcccagtctgtctgttccagctcctcagcttggcagcacagggccacagatatgtgtagtttggcccacagagtgttttgattttttttcttttgaagagttgtcatgacttaaaccttggaaaagtcacacacagtgttggagttccaacttctcttgcaaaatcagaagctctggcatcactgtccctcctttcctcaaggcaacccccgagggggttggagatgaatgtaaaatgcaattctcagttcaatagagacctcataggcctcttctgtctgagcatttcctgcctggctcctgtaggcacctgagtctctgccccttgatctctgccctactgaggatggtcagatgggaaagaacaaaaccccttggttcttaggaagagattgtttcaaattaaagtcttgatgcctaattaggaagccagtttacatttcccccgagggagaatagttctgtctcccaggaaagagttctttaaatgggacagacctggatggcctctaagtgggtttcctttattcttccgatttcttctttattattttttaacagcagtgaaacgctttctgcagagaatatcttatgcaaaaacccagtgtaaaatacacatccaagtgactgtgctcagattgaatgtgttttgctcaccttggaaaattggctgcttgactttctcttctgctttttccgaggtggctctgggacatctctgggtaaactttggttcctcagaaaacccctgccaagagcgttgtgagagaggctgctgcaagctggaggaacaggtcgtacataaaagggttaaaaacaaacaaacaaacaacaaacagaagcaaaggtactcttggttcctcaccttcgtaactctgggccaacctgaaattgaacagcttgcaaaaggcaaatctggatctctacctgtggctccttcactccctgggggcccgacacggacggagtgagataacctgagtagtagatggcaaacatcagagtcgaggccctgcaaacgtgcaaggcctgcttcatcactgtgactggagacttggacctgtatccttttcaggagtgtgtcacttcctgtggcatgcagcgtggaaaagcagtcactgtcctgctgtagctttgaagtgggggctgcctctgtctaatatggtgaggtgctggttcatggaactctgggaccggggccttggccacaatctgcaggaaatgctcagactcggaggattcccggaaatgagagagaggtttctgagcttctctggcttagcctagcagctgtgctgtcacgttattacggatgcttgtcattgaagcatcactgtctgcaaccttgacatgcaccatttcagactcatttttcaaaattgctttgaaagcccagggcccatcccatgcattaggggaactcctctgtgacaggtgctgggggtgatggaggcagcagagaagtccctgtgcagtgctgactcatgggagcacatgtgaaaagacacaggctggctgctatgaagcctctgtaggggtttagaggtgttttccttgttagaggaggacatcctttttctacagggctacatgacccccacctgtacaagcagctttctggcaactgagctagcacaccccactctgggctgtctgtagttctggtggcttcgcctgtccaaactgtaagctcttaggcaaacttctatgactttttaggtttctgtttcctcatctgtataagtatgataatatccacctcccaaccttatctacatattagaaataatattacctacctcataatctcatttgtttaatataaatgataatattcacccctcaacattaactgtataatagaaataattatacctacctctaaatattagctgtagaatggaaatgataatactcaccttgaaattatgtttgagaattagaaataatacgcctaaaatgccgagaagtgcattaaatgattaacgcatttactacgtgacaggctcaggaactcttggctttccagaggcccgacctaattcacatttttgagcctccaggtatgcttaaaaaataaaaacatccccaaattgttgcaaaaattgttatattttaagtgtttattttggacagatgaatgcttttaacaaacatactagaatatataaatagcctcattcggggtgacctcaaattctggctccacagctcttgaagagatggcgtctaggccaaatgcaccacccccatgcccattacaggctctaaataggcccttaataaatgatagtcatcatagcatgatataatcatattatatctatccctggaggttataaacaatgtttcctctctagctttatctgctataaatcaactgagtcttcccagcattaaaacacttcatgatgggccagtgaaccatggtgggggaagcacagaaggagttggctccagctgttggcagctgcagagagttactgaggcccacgtggggcccacatatatggctgtgtggcttttcgtattgaataatacccacagaccagattcaacttgcacaacggttgatttctggtgaggcgatctctgctggccacaaaacgccccaggctggatggggtcagactgcgattcttttagctagtgcctcggcagcaaggcatctccctctggacatccagcaagactcctggtgatggtgctgtcaaaacagacttccctttactaggactggtaatcccatgctttggcctccagttaatatgtgcatgccttactggggagaagggacctcatgttcttggattttgctgacatggactgtgcaggtctctaagtgccaatcgcagggaagagtcaacacctcatcactgacctaggatagcataaatgcagctgcttcttatccaatgacaggaacccattctgagcctaggtgagggaagacaaggattccaatgacaactgggccaccctgacttgctgtttctcagacttcttaaagtttgactgtcagcccacattgcccaagttggatgatcacacttctgaatcaaaattaggaattgcggtttgcccagtattttaatgaccacaagggcagtagggatagggtattctgaagtgggaaccttcccattatgtgtgggatggaggaaatccagggcacacaaacctttccattatgtgtgggatggaggaaatccagggcgcgcaatcacgacatgcagaagtgaatgctcagagctggtccatctgagctgggccaccagtaaagggcatgcatttgaggagttaattctgggaccactctgtaccttgtaatcactccttgggctgttataatcaaatggaacttaccacaaagttaattcgagattatatttagtgatatgctttatcgttgttgtagtgagtggtaattaggaataaaatgggaaacaattcccataaaagattgtgattagcattgattatgcagacaacccgaggttttccactcgcacctttttgctgcttctgtctctctaatgagcattaattttgcctcctcccatgctctgaaacacaggcctgcgttctcatttcgtgctttggctcccttaccctgtccctctccccactggtggctctgggttgaggatcagagtgctgcttttggtgcccattttgccagaacccctccttagtttcctacttctagagtccttgaatatcttctctctgcccctcacctgccttgggtgcctggtgaagcaggggaggctgcctgggggaggcagctggtgatgtgggttttggtcagggggagaggtgtcctgggaccaaggctagtggagagaaggctagattaggggaggaagagtgggaactcatcagatggaagctcttgcagaaaacatctcttcaccaggtcagttaacatccagagcagttggggataaattatcagtttagaggcaaaaagaatggtgaggccttcctctatctgcaaatttctccatttcctatttctgatggcctggaatttccaactggagacaggcatttcattgcatgctaaaggagatgaggtttaaactgcaaacactgagattgtccaaacactgatgtgaagagtttcaggctccaggcaaattgccacatcagattcttgtgtttctgggtcaagttgggggctagagagcagaggactgctgagtgtctgaggggttgagaagagtgctgagtggagaaatgacccagaaggagaggcctggaggtaatgaaagcagaacttttgactctgcagaattttgcttgagagcatactggtgtgctgcacttcaccttctccagcttgaccactcgggaaccatagcattgaccaggcccttgggctgcctatgaggctctccaaggctgcagtgcctttctggcaagtttcaaaccagagcagctctggactcttctatctcacatgcttcataaaaagtttttggggagtgtatataattttttcatcgcaggggtaaagagctattcttgccctaccccttaagtctgtcctccacttaagttctgaaaatgcaaatgagatcataccatttctagctaagaatcactcaatggtatcctaatgctattagaataaaatcctagctctttatttcgaagcttgatttcatctgttgcttacctttcttctgatattatctcttacctctctgttcattggtccctccatctgtaatccctccctccccttcttccttccaaaagtctattcatccctctactcatctctccatcttcctttccttctgtccttccatccatttatctatgcatccatctgctctgatgcagccacagttgctttcttggtattgctgaactgccttccattcatttgttctctgcacttgtttttcgcgctgcctggaatactctctttctcttactacccacatggctcactgttctcttcccctttttgggtctctgttctaatgttgctttctccatgagaacttcccatgcctttgaggttgtggcttgaagggggcacgtgtggcttctgaaatggttatcttctatttcttgacccaggtgcttgtaacattttttgtgttcaatgtgttaacatacagtaagcttaaattttatctggtgcacttctgtatgtgtttgttatacttaacaaaaagttgaaaacaaatactctgactcccatctcactctatttctcactttgtgttattttatcttcatggcccttacactacgtgacattgtcttacatcctaattttcaatgtctgtcatctcccatgccacatggaaatttaatgaaacagggattcggtcttatttcctgctctattcccagggcttaatacagtgcccaacatgcaggggaaaaaaatcactgttgaatgaaagcgtgagttgctaccttaagcaactgtaaggtgtaacaaaaactggggaggtggctcagctaattcatctggtgcttaagttgtaaaggtctcagatgggcatcattgctcatggatctcctttctcctctcagaattgtctgttccatctgacctgttctcttgactctctgtgacagagtttggttcctttcccccagttgctcctcaacactcgctgatcttatacgtgaccctcctcaccaaggaaccaccttagagcatccatgcggtgccaggtcaggtgccaaagaacaaagtgtgtcagacttcggccaattactctgtttcttccacggggattgagtgcagtggataagaacaccagctttgatatccagagacctgggttcgaattctatctttgtcttgttctatccatgtaaccctagacacttaactgagcctcagctccttatccagataatgagattcatggtcatatctgcctccatgggattgttttgaggatttaagtaagatgttgcttgttaagcccttggcacatttcatgacacaaagtcactgttaagaatgctggcataaagatacacgcacatgtatgttcatcacagcactattcacaatagcaaagatacagaatcagcgtaaatccccaacggtagaatgcataaagaaaatatgattcatagacaccatgaaatactatgcagccataaaaagtccaagatcatgcactttgcagcaacatgggtgaagctggaggccattttccttagcaaactcacacaggaatggaaaccgaaatactgcatgttctcacttaaacgtgggagctaaatgatgagaacacatggccacacagaggggaacaagaaaccctggggcctacttgaggatggaaggcaggaggagggagacaatcaggaaaaatacctatcaaatactatgtttagtacctgggtgatgaaataatctgtacaacaaacctccgtgacatgagtttaccttataacaaacccatctactcctgaacctaaaataaaagaaaaaaagaatgcttgatattcttaagcattcagtcactgttggctccaacaatactaacattgattgttattgagatccacgccctcccgggatgtaatgatgccacatctctttctactttttacctttagagattgccactggggcctgtgccatgcatctgccttcactggctgtgtgtccatgaaggatgatgtttcgaaaaatgaacttctgatttatattcttgtatgttaagcaagagagagtgtgagaaggtccttgaaaagccacacagtgctttgtagatgcgcttgctgtcactcaacgactccggtttgcttgttgtcttcttttgtcgttagtgtggtagagaaggagttgtgtggctgttgattacagtaacaatgagcagtcaccaaacttctccaaggcagtttcttaatttggggaataaaataacaacagtgcccaccttcagagagattttcagtgccctagaaggtgctacatgtgaaaatcaattgcaagaaacacagaagaagttcacgtattcccttctctgctccctcttcttccccatctcatgtgtagtttaattaaatctcaggagagcttttaatccctctatccaaactttttccaaatgcttttttacaagacatatcaaaatttaaaaaatttctgcctgtatcactggctgtcttatcagtctttatcctgaggaccacagaagaagcccattgggatgagcaattctctgcaaagattcagagctgagatgtaagctgcactgcagataagttctcctgttatttgactgtatcccagttcctgtcagctgtattttttttccatatgcatcacactgagtcattacgatcatagcagctgattgattttaaaacatggtctcccattgctctagtaagcggtggttgacagattgcccagttagagaaattcctgtgtctggaaagcaagaggaaaagggtctgctatgttttgggttttggttttgtatcttctgttgtctaaaaaaaaaactgattttttttttcacccctttggattttctcgatggggctgactctcctttatagtcaacaaacctctgcagcctcactcatcaaagggtggcccccaaattggcaggatcagcagtagctggaacttgttggaaatgcagaatcttaggcaccactccaggaagcagagtctgcattcgcctttccccatggttgctgtgcgctggaaagatggagaagtgctgttttataggactgcggtcctggctgaacccagtggggcctgggcttggcatcagccttttaaagccacagacacctcttggttctagggcgacatgcagaggagagatggcacatctctatagaggaccatccgctgagatgttgcatagtcctccacttctatggaccctccacctgtttgtctggtgccagatgtcttcagctggacctcattttcccctccctgcaggtctgtggtctcacagggtaccaatcactatagcggcaattgttgttacctcttctgatgccccaaagcctccctaagagtgtgccaactgattcagctagagaaattcaagtattgagaaaggaagcacaaattggtttgtttttgccttgcctgtctgtctagggaaggaatctctgctatttcaaatgtctgacaaatggacttgattatcttcttcaagcaaacttgtggtccagcggcaggaattgttggttgtcagcaaatctgctggttgccagcaagtccttttctttgctgctctccatcccaatgacagaagatttttggagacgaaacatctgagtttatgtttgagaaatgctagtgcaggtttctcttctctgctccctatgaagaggtgacctgtgtatgtagaagttggagtgtctgagatgaggttgctaatgactggcatcgggaaccagtggagctatgctctggtgtcagttcattactaacagggtttttgctttatcaacttgagtcttcctcttcatttgtttgttttattcagcagatataaaactcgaagcatagtggttctcagtatgatgggccctacctcttgggtttgcatcctggcttgccacttagcagctatgaggcctccaataagttatttaacctttctgtgcctcagttttattgttcataaaagggagataataaaagcatccatctcatatggttggtgtgaggattatattgattaatattaccttgtaataagtgaaaatcattctggcacttgtaagtacagtttatgtatttgctgttgtattaatactatataggtcaggcacattgctagggaatgaacacaggcgacaggcaagagccctgccctgacagagtacacattccctggggagatgagcagtaaacaacttttcaccagtccaatatgtaattacgtactgagaagtgcagggacagagatatgcaggctgcaggcagagtgaattcaggtgagtctggcccacttggggcatatcctagaaggtgtccctaggaggtgacatttgtgcctgggattcaggggtgctggacaatggccctggggtggtggtggtggttgtaagccaatgtagctcgagtgcagacagtaaggggtgtggaacgctcagagatgagtagggccacagaatgagatagaaattcctccttagggatcctccaactataatgagcattagagtagcctggggatgctgcttaaaagtgaagattcctggaactgcctccagaggttctgattcagatgatctggggtaggagtcttcatctaaaatcctgaggccattgatgtagtggaagacagtgttgacagcacacctaggctatgttaaagatgtgtgtttttatcttaatcttgagagaattggggaacaactcaaggttttttttttttttggtacaattatgttgcaatgtacatacagtcaaattcacatttttagattccatcggttttagcaacgtatacacgtacataagtaccagtctatcataaccaagacgtcgaatgtttttgctaccccaaaatgttcttttgtgccctttttgtagaccagcccttcttctactccaagcccctggcaactgccgatctgttttcctccatggaatttgcccttttctgagtgtcacatacatgaaatcatacagatgtagccctttgtgtctggtatcttttgcttggggttatgcttttgcagtcagtccatattgttgcatgtgtcagaattattccttttaatttatgagtaatcttaaaggggtgtaccacagtttgtttatcattcaacagttgatggacatttgagttatttccggtttttggaggttataaataatcaaacataaactttcacatacaggtatctgtacagacatacgtttttatttctcttgtgtaaatatcaaaagtggagttgttatatcatatagtaagggcatgcttaatttttaagaaaatgccaactgtcttctaagttggctgtactcctttgcattcacaccagtaatgtgtgagagatcctattgttttacgtccttaccagcattttgtattgtcagtttttttaaagtagtcatttattgtggtttgaatttgaaatttccaattactaatgatgttgatcatctttccacatgtttatttgtttgctttcctagctcctctttggtaaagtgtctgttcatattttttaatcagttttttaaaaattgggttcttttattcttattgagttttgagtattctttatatattctggctacaggttcttaatcaattatatgttttgccaatattttctcagtctatggcttgtcttctcattttcttaatagtgtctttcaaagagcataagttttaaattttataaagtccaaattatcaatttgttttcttttatagttcatgatttttgcattttatctaagaaatctttgcctaattccaggctgtgaagattccctcttagaagtttttacagtttttgatttagtatttaggtctatgatccatttacatttacatctatgatataactttgaaatgtggtatgggtcaagttctcaccacttcacctttattttttaaaaaagtcatttgaccacatatatttgggtctattttggggaatcctagtatatttcattaatctatatatctatatttttaccaataccatactgtacaggttggcaaactattggctacatccattcttccacctgttattaaaaaaaaccttttatggaaacatagtcatgccatttatttacctatcatctatggctacttttgtactgcagttattgtgacagagatcatacttccaacaaagcctacaatatctctgtctagtctcttgtagttaaagctggttgatctctgtcataatttcttaattactctaattttattgtaaatgtgaaaatcaggtactgcaagttgttcaacttttttttttcaaaattgttctatccattctaggttcttttctttttcatataaccttcagaaacagcttgtcacttttaacaaaaaatcttgtagaattttgattgggatgacattgaatctattggtcaatttggggagaattaaaatgttgaatcatctgatacttaaaatgtggtttatctttccatttttcttggtctttttaaaatcttattaatgttttatagtgttcaggatacaaaccttatacttaatgaattagatttatccctaagtattttatgtctcgggatgctattgtaaatggtgcattaacaaaaataattcaatttctaatgtttcagtgctagtacaatcgacttttgcatattggccttgtatcctgtggctgtgctgaattcatctattcattctagtagcattttttgtagaatctttaggattttctatacagtcataacatctgcaaatgacagtctttttttttcatctgtatgccttttatttttaatttttgctttatcatactgcctaggacttccagtacaatgtttaacaggaatggtaagagtggacatctttgcctttttcctgatttaaggggaaacagaagtattttaaacaaggagttgatatttgtctaattttaatcttgtgtagcagcagccagttcctacttgtttcaaaggaatagtactgtgtatgtatacctcctgaatcagatagctgtcatcacaatgcagcaggacaaatgactgcatatctcagtggtatatgcagcaatagacatttatttttggcttatatatttgtgggtaaggttgggctcagttgctctagtctgggttagttaggttccaggctgtggattaggttaagtatcttataaatgtttcttatcctccttggacagtgactatgcagggcaagttcttctcttgttgaagggcgggagtgcaatacgcaagtctagctgttcaagtatgtttcaaacatctgactgcatcatgtctgttaacatctcattgaccaaactaagtcacacggccatcacaaagtctagtgaaggggaagtattcttgtcctaccatgaggctgtggtaagaatgtggtggatgatattcctccagggtagcaaagaattggggtcaataattcgatcatcacatctcttaaatgaagaaacattccaactggtcagggtagacatgggtgtccttggccctgctataagtaagtacttcaagggccaaggtagtgtctgcctcacctctctatattcactgtgactagcctatgatatgcatttagtagatttttgttgaagaaatgattgggacttgttagtggttcacattttagcctattgttttgttgctagtcaagagattccttgtataatatttacttcttctcatctatgtttataatcagctcaacaggctccagaaaattgctttttagtgacagtaagaagggtggaacaatgagcacatttgtacccaaggaaaggttactttcctcataggaaattgctgtggaaagagcctagagtgagaaggcaacaacctgggcttgtgtattggctccaatcacctgctggctgtgtaagggcagtcagtttaggtcatctccctaagcttctgtttgcccatctgtgaaatgtaaatattgctcatctatattttgccctgtacacttagcaagattttttgtgatggtgtagctgaaatgtatgggaatgtatatgatgtagataacattatgtatatgtgtgtacctgtgtattgagagagagagattgagagagagagagaaaccataaagggctgtaaaatagaggaaattgctattctgatgatcacaggttctagggttggtaaggagatttcctcagcttagagaaaggctgtgctctgagggccatggttcaagtgagaacctggcggcattttgaatccgctttctaaaatcacactcttgtttcccagccccctaggtcttctctctgtagcttcccttcgtactcagggggatgcttctgcctcttttgtctatcctcatctctcctctcctcacttcccttcttagcctctgaagacacatgggctgctttcttcaaatatgccaaatgctctgtcatctctcaggcttggcatatgctgttgcttttgcctgaaatgtgtcccccccaaaccctcaaaccttgctaaatcccagtcacatttcagatttcagctccattaagaaatcttccttattccctcatgtctaagtttctatacatcctgtgcaaacacgttctgttcagtaccaccctcatgcagtactgttaaatgctatttttctctgaaatgtattctaaaaccatatataagttacaaaatatttaaatatgaagaattcattacactattctctctgtatgtgtgtgtgtgtgcgtgtgtattttcccctcctcctccacctcgtcctctttcatctcctttatgtcctgcatgctaatgtctctcgaccagagttcagtgagagcttcaggctggacagactgtcctgcacacccttgaccagtgaacatcagtgtgcaccttgggaatgttctccaccgtgagcatctacatcataatcctgaaaggagtgtgtttggcaatatacgttatttcctctgcgagagctttgcttcctgccgtgtgtactttgtgtcctgtatagcagctttgagttcagtaactgaggacagctgcgcaggtggtgatgctggacctccatccagcatcatcacctaagaatgcaaggaagagagtcacactggaggctcacatgcactgttgacagtggctggggttcctggtggagaaaacagagggcaaagaacagcaggtgctttgggaaagtgggaaggcctctgacattatgacatcatgacatcactgtaacagcttgggaggtttgtctaacaatagcttgagatccatcactagcacaaattatggatgagtggcatagcgaatttgaagacagcttgcacaaatccaaatgaactatggtataaggatccaatatggtgatgatgtacttaccattcccattccagaaatgtgttccctcatgctaaacggatgcaagtgtgcttcctaatggcaccactgcactgcaaataatggactctttgtttacccattcttccttttcccaccactggaccgtagcgcatggctcttgccctcatagaatgagtgaatgctgtggtacaccatccatttcctcctctggaaagcactgaagcatttcttccctcactgtcctgtgtgctgcctgctgctggctcatagctgagttcttccctgggcattgctctgggtgtagggattaccttacctgagattactccccctctctgtgaccagccagcatttaatgggttatgggttgtaatgggtgggtggtgtaccaaggccagtcccttgtcttaatttgggacactgaagggcccccaactgtatagcccccatggactggctgaggtcatttggcaactgcatcacagtttaagttccttctatccaacctagcttttcccacttccttacaggggctgttcccgagagggctccctgagaagtttcctgcatgcagttctccatcttggattctgtttcccaagaaaccaaatatatccccctatacttgactgattcccagccttgcagggtctgtaggtagggcctctatttcacaggtgacttgcccaagaccacccagattctgagtgctgagcagggaagatagctatttcaaagggctgatggtttaaatgagaatttaaaaaggtaaccacaaggagtaagttctcattaaatgctggcatgctttttctaaatacttagggctagcaccacagagttggagagaaagggaagagagtttacagagaagcatgcatggtttgcatcaccctttgacgaaacaggatagggaggaaattactacacccttgccctggctcaaaacttaagcctcttcgcccttgcccagttggtctatctctgtttcagtagcctaacttcacagaaagaacctttctttgcaatcagatttgatgtaaggagacattagctataaattacctgctccctagatactcttatttccatgtactaaaatactttttttttttgttagaaaacattttgaccacacactgagctgattatcaatgtaattgtgctgtaatcacatctgagggaactatctagcaaatcaactccaactgtccgcctactcacagggaagagactcaaacctgtcacatcagaatagaggaacaggtggcctcattcacaaacagtgatactccttctaccacacagccttttctgtcgataaatagactgaaggtatggtttgagaggcatccacattacatatacagaaaatgttcataaattgatggcaaatggctggtcattttcctaggaaattttggtgtaggtggttcatgagatttttgttttttgacattctggatataatgatgataaaaagatattaggctataagaaattaaagccaagtccttattattcattcaattttaagcttttaaaattcaagaggtctgagtttgaatctagtgtgctgtgtaatcctggaaaacttgtgaattagtcaggccaggctaagctatgctgtagtaacaaacacgcccctcaaatctccatgggtttacaataagtctcacaaagtcctctgcagtccaaggcctctttaggtcagtttgattccaagttatgagtcagggatacagttgttccaccttgaagcttcctcttctcaataagtgccttctccaatcactgtaccaggggaagagagagcagagagcaacctcatccactctgttaagctttgaccttaaagggactcatttcttttgctcacagcccattggccagaattcattacatggccttgcctaatgcaaggaggctgggaaaggttggggagcacagatatattaaaggaacaataattgtgtctgtaggaactaggtgtcaatttctacatatttaaactaacttactaattgaatagtgcatgcattaaagaaatagtacatatattttaggtttagtcattgtattaagctctgggcatataatggtgagtgagatacacgtactgtttgccttcactgcacttttgtcttgcagggaggttagatgtgcaaacaatgatagtgaagtttgaatgagtgctacagcagagaagacaagggcttcatggtggttcatggctccaagttaacctctgggttaaggacaatttcttctggacgtcgtgttatcttagctgaagtctgaaggacaatgaaaggaagtagaatattcaaagtggagaaattgccattgtaaaggcctgagaaatggtagaatatctcatctttctccacaaaagagatggatagtttccttgagataatacatacttagggtgttttgtaaactgttaagtattatacatccttgaaggggttactattcaatactcacatgagaagcacaatttctgttactattaggttgatgtacaagtaattgcagagtcaggggtatggacatagcataaatggcagagttgagtcaaacacaggcattttaactgctgagcccaagttcttaaccacagagcaacactgcatgtttagaaagcaagttagaatgcaaatataaatgatagtattacagggaccatcaagaacttgatccaacttatatatgtatagaagagtaaataatatgcaacttctgattcagctttagtagtagaatgttaaatgtttttattagttatgaattggttcgaaaaccatgcacaggggcacttcagttaaatctataatatagactggacatctggtcttttttcataaccaagccagggacaagggaaatattttctttagacttagtggatcatgtcttctaggtctagaaatcattcccatttctatcagtcccagctatgcagctgccatttataggtgagacaagtatcccccctctcttgacttaagactccaagggaagtagcagtgaagaggtgaaaggaatgggcaaaggaaaatctgttgtgccaagaagaaattaattctgtccatttttcactcatcccagctcattttgcctctattgttatgtgaggactaaaatattcattttgtgaaaaaattgtcaaactttagtgctttgagataattgatgcttttcatcagctcaccaaattgagagaatgactcgacagaggtctgcatcaggcaatctcaggcgagaattcttttataacattcatgcaaaggccctccttggagatgctggtaagcagcccagtgattgtgagacatcggaagaaagcacacttgcagaaccagactgtgaacaaagggctttagcggccaggaaacgcactcacgggggacttgtcggtcccaggctctgcctctgattggaaatgcaatcacttggctgtgtttagctgtgtccagtaaggggccattggcagcaatgctccactaactagaaatctcttctgcaatcaaattaaacagagccacagcatcctcatgacacatgccagttatcatggagacgttttattgcagaaatgctttttaaacattaattatgctgcacacaatacgacccagataaaatatgggcatattatgacttgtctgtggctttggggtatgctgtttaatctttgacaagggcttaagggaagaaggtgggctggaccttttgttttgaattttcattgctggggcattctgcatctgcctttcaaaggtggctacaaaaaggcttgggttcttattactcacccttaattagccttgtcctcctcccacacttccatgtctgctagaggattcaaaggccctcagattgttgggaggctgtgagattgacatggggacccattgtttaatgaccctctgcttatgccaggacagtcatcctctgtctcctttagtgttgacatcatgtgttctgattggtgcctataacttaccaagttgttaaacagtattttttttttttttttggcttttgagacagagtcttgctctgttgcccaggctggagtacagtggtacaatcccagctcgctcccagctcacttcaacctctgcctcctgggcttaagcaattctcctacctcagcctcctaagtagctgagactacaggtgcatgccaccatggcaggctaatttttaaattatttgtagagacaggtcttgccatgttgcccaggctggttgtctcaagctcctgggcttaagtgatgaggctgcctcagcctcccaaagtgctggaattagaggagtgagccaccatgctcagccttaatagtgttaataccacccgtgaaagtaggcatcatcttcattttttaaatatagaaaatgaagcttagagaacatatgtgacttggcccatatgtcaccatcataagcagtagagttagatttcagtccatttctttttgtctttataatctttccaaggcagtctctaaacttttgtctaaaacagtgtaaatctttcattacattagatgcaatattatgtgaatgttcaaagagataaaaatgaatgcaaaagttgcttccctggatgaagaagctctgcacacagctgcctttcatcccttcctctcgtagcccccaaggtggttgtctggaacctcaaggtgtaaagaggacttccctgatctgcatctcatcccaagggcctcagggcaaatgaatccacctcttgctcgtgatttgcgtgtggagctgtcttctgtccagttctctcctaaaaatgctaggaaaatgcctgtggcccaaattgacagcagtccctgtcttctgggaatttgccttttccctgagttaatggaagaaaaaaatagtaagaaagagaagtctacttcatgttatatggcataagaactatgaacaaaagcagaacagaactaggagatagaagcctgtggaagagacagtggcacagtattcaagagggtgaccagagaaggcctcactagaaagatatttgagtgaagggggccagccctgcagatatctgggggaggatactttctggccttggggagagcaagtggagtggccagaacgacagccaccctcaggtgagaacaggcctggaggctttgagaaagaaggccagggggctgaagttctggggagcagagtgggagaagaggccggcaaggtaacagggcaggtctgaaggaccttgtgggccattttgccctgagggagatgggaaaccactggagggtttggaaccagaaagagccatgatctgtgtcgtagtccatttgtgctgctataaaggaatacctgaggctgggtaatttattttaaaaagaggtttatttggttcattgttctgcaggctggacaggaggcatggtgccagcatctgcttctgaagagggccttgaggcacttccacttatggtggaggcacagaggagccaatctgggcagggatcctatggtgagagaggaagcaagagagagtggggcagatgccaggatcttttaaacaaccaggtctagagaggagtgatataccttctgcctcacctaaggatggcattaatctatccatgaaggattcttccctatgaccaaaacacctcccactaggaccctacctccaacattggaatcaaatttaaatgtgagatttagggagacaaacatccaaactatagcagtgtgactcacgtcttcacagaatccctctgatatctgtgttgacaacaggctaaagttggcatagaaagagtcctggcaaaaatcagattcgctatgagaaagataccttgggagaaatgagcccttatattgaacctcttttgtttcagtatccttattatcttcggggtccacttcaatttgaaattaagtgtgaggttaaaaggaaaaatgaaaacacgtgtgtgcacactcatgaatgtgtatgtgtgtgagtgtaagcatgcacgtgaaatgtatgaacgtaacaatgtgtgcatgagtgtgagggcatgtgattgtgtttttgcctgtgtgtgaaagtgagtgtgtgaatgtatgagtgtgttagtgcttgtgtgtgaatgtatgtgagtgtgtgtgaatttatgagtgtgttggtgaatgtgtttgaatgtgagtgtgtgaatgtatgtgttactgcatgtgtgtgagtgtgtgaatgtttgtatgtgtgtgtgagtgtatgagagtgtgagagtgtgtgtgtgtgtgtgtgtgtgtctgtggtgggtgttttggggaagaaggaagtgtaggcttgctgcccaggactatctggagcagatcccaaggcacagaccctgtactggaggcagtatttcaatcatgtgggggccagtggagggtttgtaagacaaagccactggagacagctcagcctagtggcttagagctcattgtgctgtgattgctgatctttgtcccagtatcctctccacctgacaccatcctcttcaagctcagttagctgactcctcctgggtgaggtgttaatctctccaggtctcctttagcactgtgtaccataggtgagccttctgtttctcaccatcctgaaccttgatggggttctctacaacatggtagactttttgagggctttgaccacatcttgtttgttgtggtaactccagggctcagtcagtgcctgagactggggaggggctcagtgtttacaaaatgagtggagcttttcttctctttatgtatgttcccatcagaagcatgccccaaagcttggctgtgccaaccaaattggtttttctttaaagctttcttaatgatcgattcctaatcagttgatcaggtcaatttgcctggtcagtctgatttgattgtaaatttagatggtgggaagagactgctttatggtccagttattgtgttcttttaatagcaacgtgggagctgagctgagctgagcagcaacgaacagcaaagtgtcattacttaggcctggcctgagcctgggatgatagtgtctgattcagggggaaaacagtctaatgctcaggacagaagcacctctgtgggggtgatgaataaaggcacctaaaaaggaagtacaaaagtgcatttacttattttagatttgagagaggaggcataataacctcggggagttggggtgacagaatagcctggcggcaagtggatccttggtcatctcaggccctaactctgggtaaattctcgcccacccttccagagcagcatcgcgggttcccctggggatcatttgggctgtggatttctgcagtgcctatttgctgcctcgggagctgtttgaaagagggatgctctgtgcagaagacacagctcagaagatggtccccatgcgactcacaatggaatcctaagcactggaggaactggattaataagattcaagtctggaggagaaattgggtcacacacattcttgggatgtgggaaattgtgctgtctagcttgggcacgatgcatttatggaggaggggaagcaggccccttctttggaaggaaacagggcagtgtggattgtccacgtaagggggtggttgtcaggtcttcaggtcagggcctatcttaggatagctggagcacagtggagcaagaagggtatgggttgcagtcaggaaactcacattcaaattttagcactaccacctgcttgctacgtgttatgggctgaactgtatctccccacaattcatatgttcaaatcataaaccttagtacctcaagatgtgactgcatttggaaataggcctttaaaaaggtgattaaggtaaaataaggtcatagagtgggccctaacccattaaaactggtatccttttaagaagagattagaacacagacacatacagagggaaggccacgtgaagaccaaagagaagacagccatctgcaaaccacaaagagaggcctcagaagaaaccaaccctgtgacaccttgacctaagaattgcaagaaaataaagttttgttttttaagccacttagtctttgtgatggcagcttgagcaaattaatacactacctgagtgatcttgagacagccgtttcatctctgctcctcaatttatccatctgtaaagtgaatataacattactcatctcatagggttctggagaggagtgaatgaaatactgaatgtgaaatgttctctgcaaatggcaagtgctgaacaaatgattgctgtgacttactgttttccttgagattgcatcattctttcatcattcattctacaaatattacgagtgcctagaatgtgcaagatggtattctaggggataggattatagcctcagaaaataaagataaaaatacttctgtccccctgaaactttgtattccaggaggtactgagtgttgggggaggcaatgagaaaaataatagtaaacaagatcagtaaaatattaatatatggcatgtaagaaaaggataagtgcaatgaggaaaataattaccgggagggggatggggtgctgggatgtgagtggcgcatggtcaatgttttaaatagtatggttggagaggggatctttgagcaaagacaggaagtagtggggtaagccaggtggacatatgggaggagacttttctgcaaagtggggacagtgtgtgccaatgccctggagcctgagttgaaaatgtttcagtttcttgtaacccatagagccccagcttaggtgacctggagggtgctgagcatttctgaagctttgtgattagcatccttctttgttctgtatgttaacccatatggtttacagatgttttcaagggtggtactgatagattgtatacctgcgattggatggttggttttggggagttttctattttcttgtttgttggtggagggggcagggctgggaatcaaagggagagtagaactagctcagaaggtctgcagctgtcggtgggcctccactgcggggctcataaggcctgagtcagttggtaaatataagcatctctcatcacgggaaagcagagagagcaggaagcctgaggtaactggggagctgacaacaggggtgaggcgtgcattttcaaagaaagtggagagcctgtgttagtttgtaagcttagtaggaggatcctattataaatgggtcctctcgaggaaattgcagcctcgtgcatatgtattcaaagaaactataaatcacagacaagtagaaaggaaaagaaaatgtaaatcaccccctaggtgctggcccaagcaacattaatacatgttagatggtggaaagagaaaatgattgtgttgaatgaagaatgaataaagtgctaccatgttggtatattttttctagctactttttccctatgtgtcttagatatttaaaaacttttagcctgggcaacatggtgagaccccatctctattaaatatacacaaaaatcactgggtgtggtggtacatgcctgtggtcctggctactggggaggctgaggtgggaggatcgcttgagcacacagaggttgcaggcagccaacatcatgccactacactccagcctgggtgacagagtgagaccctgtcttaaaacaaacaaacaaaaaaaaaaccaaaaaacaaaaacttttgatcctatcattttagatcctgatttttttaatcttagtaataaaacaagcattttttgttatgtaacttttcataaatatcatagccttatatttcatgacattaatgtattagaatttattgcagcattcttccaatatttgcatgccatgattgctcccactattataaataagactgtattgaacatctttatgctgtagttttcttttttcttttttatttcctcccccaacattgttaagattattttcctagaatcaatttccagaggtagaatagaattactttagtaaatggtaccgtttcttcagggctgtcaaaatcaatgtgaatcttctttattttattgtctatttaatcgcttatttcactcagttttgtttccctcataaattggaaaagcatcatttccatgtctttactaagatgctgctaacatgttgagcagaatgggtccaaggatatgatttactccagtttgaaagttctttatgtttgaagtttccatttctataaattatagtactatcttagttgatataaatttaaaattttgtccaattatttttcttaaagagggatgcctgagaataaccattgatgtctaagtgtgcagtgcatgttttcctagtagtgagattttctaagcttgatgtatttaaagagagattttaaaaagcatttagcattggtatcagatttatttagttttaattgttttatgtgagttgaattggtatgagtagatttgtgatgttctttgcaaaattcatgccttttttagcagggcgtgtttcacaaaataatcttgaaatggctagacatccttatctttttaaatggtttttaactcctattagctataatgggatttccacaaataaattgccacattttactgaaagatagcagagccctagctgaccctcccaaagcatgggaggattttgatacacacacacacatacacacacatcatttttctctctcaatcagcacaacttttagcctccataaaagaatagggacatattgactggacaatgatgtgtgattctgatttttgaaagtggacaatgtgtttccatcagtgcattaggctgtctgggaagaacaattctttaaaaagctctcaataaatgacataaataaaccagtgagcagccaggggccaaattatgtgtccctgtgacttactgttgtttgaggacagtgataaacatttcagaccatctatggaaaccactgggggaacttttgtttctctctaatagcctctgaagcctttatggctaatagtgtgtataatgagttcagttgcaagcctctgagcagagaagttgggctgttttcatgtggggaggggaaccctctgaaggtttgcccagcagtgacagaatccggtcctctgtaagggaggcaccaaccccacatttggggaagctgggaagaaagagtgagaagatgaagatcctaagccaagatgccaagaagaatgtgaaaactggagcccaagtcagagtcagatgtgagatttaatcagagcatcacagccagagaacggagggtaaagtcagagccaggatactaacctagctcacagcgggaacgtgttgcagcctggaggatgctcactggaggacgctgaaaccacactcttgccagtggaagaactcctgtcaccctcctcctcttaacccccttggagacctccgtgtagcaggagtctggggtaaggctccaaatgtccatttaacaagctccacaggtgattctgtggcccagccctgctggataacgactgctctggttcagctctgactaggtgtgggatggtggcaactatgtccatctccatgtagatctctcagctagggactgagaggccagaatcccagcaccagatttcagtgaagttcctacatgtcactgttatcgcagtcgtggtctctgtgtttgtgaaatgaggcctggaccaggggctctcagccctggctgtgcattgtaatcaccaagaaagctttgaggaaatgtcaaaaccttggtcccctctcggtcctatggaatcagaatatctgcagggaaaacctgggcatctacaggttatttgagtgttgaggctcagaggagtaaagacatttggccaaattccttccagatagtcatttatacagctaggcttgaattgaggccttttctgtcctggaagagtaaataataattattgttgttaataataataacaaaacacaagatgaatcagcagtgcaggcactagagccaggttggcaggctgacatctgggtttgagaattggagagggatgcagagagttggaatactgtcccgtcagcttggttgtgtagggttgggacctcagcgttggagctgcagggtaggaggaacactggtggtgggtgggacaggaactaagaaaatttagtgcgaccctagggtaggcgctgaagctgtagaaacaactcaaatcacggtgtcctagaaagtatggaaaattttatctttttcaaggttcatgaccatgctaatatgatgtcgaagcagaggtctcaacgtgagccagcaggggtcttgaggctgagtcaggctgatgatcttgatgatgactccaaatcaggatcagggtcatgatctttctagggttaaggtcagtgtccaagctaaggggggaagacagtaccaaccaaagcggctgacattcaggaaaaggctccaggctcaaaaagagctcaagaacaggttctcaaaaggtagcccttggaccagcagcatcaagatcacctgggagttcattagatatgcagattctactgaatcggaagctctgaggagtagagctggtaatctgagttgtaagagccctcagctgagtctgatgcatgcttcaggcggagacccactgatagagagtttgaataaggtagtaaaggcagaaacctaaccaggcaaagccggtgaggctggggaagagcttggagaacatacggtgccaagagcccacaatgcctgatcgtaggcttagaaacacgaggaaacctacatcccactgttggatgcacgcctctattgctcaggatactggggtggcattgaagttgggatgggacatagctgtagcctatggctgagggtcttcaggaaccacagctgactagggtaaggagtgtcagagactacaaaggggcaggggaagagatgccaacatccacggacacacctggagatattcaggtggtgcgtctttttttcagatccaggtccaaactcccaggctgagcttggcttactatacaagtctgcctcccttactgagtcttgctggacagaagtggagactaaagctaaatgtttctgagaggttctgtgtccagccatgttcaggtgatagtactgccactcccatgacatcttcctcacggtcagtaaatacaatgcccagtgaacaggggagttattcaacacacacatttcaaatatctcttttaatgcccacatgtaaaaccaatcagagactcccttttctgagagggcagcaatgatgcattcccagtaatttgttagaaataaatgagggagaggcaaatatatgtcagataccctgagccctccattcacgtggatttgcttcttataaagaccgataactgaacaggtctgaaacaagcacttcctcctgtctccgaacactatctggaagaatccttgaatccttttttctaatatgattgatgtgaagtggtggatggcattgaaagcccacattatggagatctagtctaaagtgactacttgagaagaaactgcctcattactaaggtccttgttgttaccgagtgcgttcaagggggctgagtatatgcctctgattagaaactgtacctcttctttgattccaggaggtagagaaatggtgttttggcttgggcagtgatgttactgaaactttgtttagtttcagcataaatggacattttctggatttctgtggtttgatggaacatcactttctttagcttgcttggcattgtgtacagagcttgattttcttgtatatttttggtggaactagacattttaaaacactttccatcatgcaattaagttttctgcaactgggaaatgctaatgtagatatatctacttgcttgcaataaggagactccagaatctcaaatgagatgcctgagatgcctgaaattactttttaactttttattatgaaaaatttcaagcatatacagaaatggacagagaagtgcactgaaatcctatgtaactgtcacccaccttcaacaactgtcagtggatgtgttttgtctctactccacccacttctctccacctctttcacccgtactggtttattttgaggcatatcccagctatcatatcatctacatatatttcagtatgtatctctaaaagagaaaaactcttaaaaatagtcacaataccattatcgtatgtaaaaaaatgacagtatccacttgccatcctcaaatatccagtcactgtttagttccttgactgaaacatatttttaaaaaatgaatggtttgtttgaaccaggatccaaaggagttctacacattatgactggtggagatgttctgagaaggttattttaaattgttccttacacttagtgtgagcattgtcttgtttgagctcagaagtccctgcataaataccgagggcttgaggtccccatggaaccccttcatggcccagtgattggcccagcaagtacatcatctgcaaaattctggcagcagagaccagaggggcaggtggtagaaaacaagatgtgaacagattgctaggaccccagcttgggggtctcaagtggtcactttagtttaaaatgtttagtccaaagtgaccacttgaaaaggattgatgggaccctattctaaaattgggtttttctaagtactagtagggaaagaccactctaaagtctgtttgatgacaggctgaggatctacttgggaagaaacttagatcaagggatgaaagaattgctccagagaataggtcagagggtggggctggccaccactttgcccaacactagtgaatccatttacctcttggacatctgtagtgtggccccattcacatcctggaagtgtgcaacatgatggccctgggtttgaaggctgttggaacacggtgcctatgactcaaaaccttttcttgctcaaggtggggagatcactaaaatctccctgggactttgagagttaaacttgctagttctggaaaaccaggccaaagtagctgatgaatttgattaaggcccatgatcccagaggaatattaggttggggggagacacttttatgctttgggatgcagttattggcacctctgcctcttttaaatgtggggaggacaagggagggtccatctatccatgcatccatccgtccatcaatccatccatcagtccacccatttgtccatgtatccattccctttctgttctatctgcttgtttctagttcttcacaattatcaggcgagttatttccatgtggccaagaacagtggctcttgccagctccaggttattcgtaccaacataaaggaaatttctctctcccatcatctgtatatcaattctagtgaggaaactagactggtccttcttgaatcacatacccacttcagctaagtcactgtgttcagaaaaacagggtactctaataggtaagctcaggtcagatgtccactcctgtgactgaagaagggtaaaagagtggactactaagggcaggaaaaacaaactaaccacagtagctatcacattccatcccaccccactgcccactgacatgggtacaactccaagttaaagcctctaaggctgctgaaaatgtggtatggacagggatcagtcccactttccgtattcagaattctattattctgcctattcagttttttccagtgtggctacctcatttcctaccatactgatctatttgttgggtccatctttagcagagaggaagcaggaggtaaagaaaataccgcagtgttttcaaaatgcaaaacatagttatatctacatagtcagccaacatcaacccctttttctttcatccttcactccacatgctatttccaactcaaggtatcatcttgccttcctctcctcttcacctcttcgcatttctccgagaggacttgccttacagggacctcaaaacagagaggagtgagaaggcaagtgggtggggtatggtaggtgttggggagaaggcagggaaatcagaagaggaggaaacagacttctgattctcctatgtacatacacatacacatgtacacacatacatgcatgtatagtgcacacatgtgcatgaatgcacacatatccacatgcacacacatgcacataggcatgcacgcacatacatgcacaatgtacacatgtgcaccaattcacacacagccatgtgcgtacacatggcacacatgcacatacatatgcacacatgctcacatgcatacacagacacatacatgcattagatgattccgtgcactgttgacaaaatcattctgaagttaaggatagttttgtgacagtcgatgtggttctgaacactatctcttgctctaggaaacttgtaaatggggggaggaaattggcatttagtcaataattcctgaactcctttcccagccttccttaaaatcttttctatatcttaagtaacaagcccaattgttaaataatggtcaatgtattcgtttacatttaatgccattataatctgtacctatagtatgcttatgttcattttataaacatgtatattttctctaggtttttaattatccagcagaatttatgatcaatcttttctcttacaacatattcatcataactataacttttctaatgcttatcatcggtcaggaacccttcacccctttacaaaattgtttccaaaagaaaaagggcattttttttgtaataatcagcttaagaacaacttatagagggagcatttgtagcaaataattgggaactgccagtacttttctttcagttccaatatgaacgtggtcaaaaagtctgggcatgagttagaaacaactgaatattgaaaatgcaaatggcatagctgaactcaagggaaatgcttcacaggcagacaaaagtaccatcaaaaatgctgtcataatgttatgaaattttaattcatgatcaaaacatctcccaagtcccaatactacttttcagtatgtctttcaaattatagtgggacttggtggatagctttttaaatattccttaaattgcaagtagctgaatatttggccctaaatactttgcaattcttactgtggctaaactcagagattcagtaagaacagttacatcagcacagagcactctgcctcttctatcttacatcttctagcaaacagaatgtgtttcaggcacgcattccggagttatgtttaacaatcccgagacatcatctctattcagcctcacagcctccggtggagatgaaatgaatattaaataatcaaaagggatggccgtgaaatcctgctgcacccgagtaaagctcagcattagggtgaccgcttttttcttgatattatatttgcatcttttttcagaaattatttgctttaagcttttaaaatgggcattactgggtaattgaggtcaggggcaaccctgagtattaatggggtgttaaagaaaactatagtttaactctgtgaaatttaaattcctttggtcttatgctgaaaaaatttatttaggtgtgatgagcttgcaaggtctcaggtaagtcatccacacctatagtggtgtgacaagaaagtaggaataagaggagactgaatgttttggggttagcaaagggcctgagttattagctgtgactagaggcctgtttgatagatgtattactcttctatggctgtgtaacaagtgaccacaaatatagcaccttaaaccaacactcgtttagtagctcatagttttgtggctcagaggtccagtatagcatggctaggttctctgcttaggggtcacaaggtgaaatcaaggtgttggctgaactgagtttctacctggaggctctagggacgaatctgcttccagtcttacccttattcttggcagaattcagttccttgtgcctgaggctcccatttccttgctggctgtcatccaggaacctgctcttagctcctacaggctactcatattccttgccacacaggcccctccatcttcaagccagcaattgtgggttagagccttgtgctttgaaatgctgacatcctccaaacaccgcatgttctcactcatagatgggaattgaacaatgagaacacatggacacaggaaggggaacatcacactctggggactgttgtggggtggggggaggggggagggatggcattaggagatatacctaatgctaaatgatgagttaatgggtgcagcacaccagcatggcacatgtatacatatgtaactaaccggcacattgtgcacatgtaccctaaaacttaaagtataataataataataataataataaattaaaaaaaagtaaagaaatgctgacatcctctgttgctgacctctagacccagatttaaagggctcatgtgattaggtcaggctcacccagaaaatattcccatcttaaggttaacagatttgggacataattacatctgcaaaaatctctttgtccatataacacaacatagtcatgggagtgacaatcatgttcacagtcccagggattctacagagcatattctccatggggcaggggactcaagggacatcttagaattctgcctaccgccacggtgttggtaaatatcctgaccctgtaacaatgagcgtgaggtccttcttagatgaccatgagcttctggtgagggttttcagaaggagggggacaaaggagtgatagttagaggctagttatctgcaagccacatgtcccatctcccaggtggtgaaataaacccaggtcagcttcctaatacaacaggtggttcattatatccttcttaaaaatctcacagaataacacgaatgatctagacattttaatagtgaaaatataatcctagccagagatgcaagaaagagcctgtcttcctattctgtcacccctggggataatgaaaattggggaaatatgttttttcctttctgtcacatacagttctgcaatcaccccctggtcagtgggccaccagacctggggtcagtcccacttgcccgtcagtcaggcaggcacctttgtgcgcagtcatgtgcagcatccctgtatagactaggtatgtatccaagccaagtgggactaagccacttagggcctggatagcagacccagcattttgttgcaactaatggaggagagaaatatgttgactgcatagtcacagagtaaggggcagaccagggtttctcacctcagcaccatcaacagtggaggccacataattcgttgcagtggggcctatcctgtgcatgataggatgttgacagcatgcctggcctccacccactagatgccagtagcatgtgccctgagttgtgacaaccaaaaatgtttcagacattgccgaatgtcttataggggtacaaaatcacccccgcttgggaacttctgctatagatatatatttctataacataaaaggaggggaaaatttagaaaagccatccagtgaggacatccattgagattcttttagaactggaaaacgcagaatgaaaagagagagagaaggagaaagcaagcaagccctttttgctggagccttgatcaaatggtacctgaagtcactagtggctttctgtcactcacaacctaaagagtcctaactaacacaagggacatcacagacaaagaaaagaggattaacatgacacctgagccttttcatgtcatttatgcatgagaaggatgagactgggtgcgggaggtagatggttgcattgacgtggtcagggtccttgtatgccagcctgagaggttgggacttggttctctgcccaccacagagggttggtataatagcccattcagcatacttgaaactctgagactgacttttacagccagaagcatattggaaagcaccccaattgtcattgtcttagatgactcacttctattgtagtaaagcaatagaacagatattaggaatgaaaatccataaacatcaagaagaatgcgtatccatcacccataaagctgatttataaagaaaaatttgccaagaaaacttgattgcttttattgatagaatggctaaattagaagatgaaaggatcacagtagaagtcatagatcttatttcagtaatgcagctgatatattatctcacaaaattttgcttgacaaattaattcaaattggtttggcagaggagatgtcggcacagattgagagctggacaaaggctcacaaagccaggataatgacaaacagccatggctggagctgctgtgagctgcctgatgtgctactagagggatgatctgtctctggcttcactgaatcccttaatttcctgttgagaaaaagggaccaataaatgcagggtagttagccttggctactgggtcacttaatggaagagctcagaaggtccctgagaatgaagaaaggacatggaggagaaattgtacacactgagtgtccttagggttaagccttgggaggaatatcagcaaactggactcacagtggggctgtggaacaagataggaaccttggcaagagtggtcagaggacagaacatccttataattgtaattatttccctgcatcagggaagctagatgtcctgatataaaagcacaaatccaagtgtctataatagggccaggtggaaggatgacacaacttagagagtgcatgacctatgtagcaatgaaaataaataaaatccatcaagctcggtgaatctgtaaatcatgatgtagagcaaaagtagctagacccaaaataagattttcaatgagatttcatttacatactgctctctaaataggcaaaactatgtagtttagggatacatacttacatcataaaaatatgatgagaagcgagaaaatgattctcatgtaggtcaggacagtggtgatcctcagaggctgatggagactgtgatttgaggggcatatggttcttctaggggtgcgagccatattccatccctttacctggaactgggttacatagatgttggcttttaatcactcctaaaattatgcatctatttcatgtactcgtttgaatatatgacatatatcacaatgaaaacggggaaaaaagggctcagaaactatttaaagaaagcagtcactagtcagcttcaatggattgttggcatgttgggatggggccaatgttgtcagaccaagcttttaaaagaaataagatatattagttaacatctgaaataagctggcagctaattccaaaattgttattattttatttatttatgtatttatttttttgagatggagtcttagtctgtcacccaggctagagtgcagtggcatgatctcagctcactgcaacctctgcctcccgggttcatgccattctcctgtctcaggctcacgagtagctgggactacctgaacccgccaccacgcccggctaattttttgtatttttagtagagatggggtttcaccatgttagccaggatggtcttgatctcctgacctcgtgatctgcctgcctcggcctcccaaagtgctgggattacaggcatgagccactgcgcctggcctaattccaaaattatttagacactgcaaactcacaacatggaccaaataaaataggtctcaaggtgagattgggcctatgagtggcagtttgtgacttcttccccaatcccaagggcggggaagagaagaaaatcatttccatcctgctatatgtatcagtgttctttgcactgctttttatctggggaaccttatgttaattgctaatgactcagtgggtctttattctcatgactattccattttagctgacagaaagtttaagaaatttgctcagggttatacagctagtaggtgagggagttgaggtttgatcctaggctgatttaattgcaaagcctgtgctagcactgattttgcaaggatccatgaatagacattgagcctggtgcctcttttctaaccctctgtcccttgcagacatcattaattgatcagtggtctttcctgctgagttgaggcccatcttccaatgcattttatcctagaactccaggaatctactcataactgactagagttggtgatttccatgaaatacatttcctgtcctgacatcatactactcccccagtggtttgggagttgacgtggacagctcctgaggtgttgctggaagcaagaattgtcagccacagtttgctattttcagttaggttcttctttggtaaagaactgatcaacatgattgtctctcactggactggattctttctgctcttgacattgcactacctgatccagaaacggaatcctggctgggtgctttccagatctggacataacctccatgcagagaaatcaccttgaaagctgcttctctcactacacctctggaaagaagaacattatcaagggtgactaaatggagtgttaaatgacctttagaaaaagagaaggacaacgatgtgcatgacatcaggaggttagtgcggaaaagagaaagggcaatgataatatgcgctaaccaggcacctcctctactgtggtcagagagggacccagacagagcatgagagagcatatggtccgtatccctcagttcacaaacaggggccggggatttgatgtgattcatcccaagagcaagggtgcttctgtcatcacacctggattctcactgtgatatgagcaaaacatagcgtagtacagtcatgctttgcatagcgacatttcagtcaacaatggaccacatatatgtcatggtcctgtaagattataatgaggctgaaaaattcctgtcacctagtgatgtcatggtcattgcaatgttgtagcacaaaatataactcatgtgtttgtgtgtttgtgctggtgtaagcaaacttactctgctgccagtcatataaaagtatagcacatacgattatgtgcagtgtgtattatttgataatgataataaatatgttatttggcttatgtattttctatactctagccttattttagagtatgttctttctacttataaaaaaaagttaactgcaaagcagcctcaggcaggatcttcaggaggttttctggaagagggcgttgctgtcacaggggaagccagctccatgcctgttattgctcctgaacacctcccaaaaggtggaggtggaagacagtgatacagatgatccaggctctgtgcaggcctaggttaatgtttgtgtatgtgtggttcaacaaaaaaagtttaaaaagtaaaataaataaataaataaaaatagaaaaagcttatagaataaatatatgaagaaaggatatgttggtatagttgtacaatgtgttgtttcaagctaagtgttatgaaggagtaaaaaaattaaaattaaaaagcttataaagtaaaaaggttacgataagctaaagttgatttattattgcagaaagataattaaaaaaaaatgtttagccgaagggtaccgtgtttataaagtctacagtagtgtacggtaatgtcctaggccctcacattcactcaccactcagtcactgactcactcagagccacttccagtcctgcaagctccaggcatggtaagggccctatacaggtgtaccattttcatctcttatatcatagttttactttaccttttctgtgtttagatacacaaatatttaccattgtgttgcgattgcctatagcattcagtacagaaacatgctgtacaggtttgtagcctaggagtaataggctctaccatatagcccaggtgtgtagtgggcttcgccatctagatttgtgtaagttcactcgatgatgtttacacaacagggaattgcctaatgatgcatttctcagaatgtatcccattgttaagtgacacgactgtaattgagataacgaacctcaggtttggactcctcgatttatatcccaattttgttatgttctacctttgtgaccttggacaaatttcttaacctctcatctatagcatgcagatgacagcaggacatattttagtgagtcgttaggattataggagaaaatgtaggtaaaagtgcatgtatctgatgcctggcataaagtaagaactcaatacatatatattttaataaacacatgtatatatgtttatatatttatataaaatcctcataactatatcatggcaagtaatatgctgtaagacctatatttccaagaacatgaatagtttaaaagagctcttcttttatgaagttggatttatgtgcccatttcaggtctgatatatcattttagaagggtagcacagtatcttttataaagaaatatgtcctaagtgttgctgtgagagataacatatcccaatagaccccttagccctttgctgacactgttctctaaggaataaagatttttagttacagaaaggtgaatataagtgacagtttcctgttctgggtatctcttaataatagttgaaagagttgtttgaaatcagatcttataaagagaaaagaaaaatccattagaacaaaagagatcccattccgagaagtgaatgaactatgtcctgatgatttgctaggattcttttcagacagccacggtcttggagcatcggtaactgattcaagtgaatgagcctgagctgattaaggatggggtagtgggcacttacctagtggctgcaattgagcatccaggagtagagtcaggacccagtgcccagcaggctattagagtgaaggtcaagcagagggcagtagcgtagggtagaagtgagatgttagactatgggagaactgtgacaccagggaaactgcaggttacaaagggtcccacagctgaaggagtagccatccaggctttctggtgactgttggcctatcccaggaggaaaacatgtgtgtttaggagcaaggtggaaggtcagggagaagaggctgttgttaagtgaactgagccagttcaggcaacaagcatagatgatagatagatactatttagatagacaataggtaggttaaatatgtatagatactagataaagaagtaatggatagataggtaggtaggtagacagataggtaatggattgatggatggtgtgttagttttctattgttgccataacaagttaccacaaacttagtgacttaaaacagtgcaagtttttatctcataattttacaggagagaaatccagtcagctagatttgtttctctgctctgggtttcataagccaaaatcaaggggtcagccaggctgtgtcctttccttgaggctctggggataaatccccttctcagctcgttcaggctgttggccaaattcagttccttgtggctgttaagactgaggttcccatttccttgctggctgtcagttgagaccacttcttgattcttggggctgcatccttgctcttgcttttgatgagatgttgccctgcactcccatcttgccacctttgccttctgctgcatgtctcgtgcatccttttttcttcttatcaggactcatgcaatcacattgggtcctcccagataatccagaataatctccctattttaagggcagctgattagtaaccttaattacatctgcaaattagaggtcatctttagaatgttgcccaccacatgtggattgatggatggaaatataggcagacaatcgataataaattgatgaatagatggatagctagttagataacaggtaggtaggcagataagtagatatgtagacagatggataatggatagatagcaatgataagttaataccagatcaaagttgttttgcagttaccaatgcctccaataatagtgtttgagtagagttcttatccagaaattagtgtgatggtatcatcgtggtctggcctgttgtttttcctttttcatggttctatatttctgactcagttgtatgtccaccacttaccatatcacatcctggtctttcgactttctgcagttggagctgatataataggtagcttttttggtttttgtaagcgattgtcttgcattccattactgtttattcttaatgcactcaaaaccatttgtgcaactatttagtgccaggcattgtgagacatattaatgatacaataaggcacaagacagacatggtccaaactcctacagtattgttagagagattgagaagcaaactggtcatactgatagcaggtgacaaatgctgtgaggaaggagaaatggaagatgaaacgcattagatgggcatacggcctatcttcagaagcctacagaaactttgtggaaaaagcaatatctaatctgagaccccaaggatgagcagggattagtcatgtctaggaagtggctgtcttgaacactgaaacctcatcaactctaattcagttgcactggttatttctgttcctaattgctactgcacagatctgtacatatgctgcacatttaggatgtgttggtgctttcaaatgcaaatgtgttctgcaaaaatgtcttctgattgtataactcagcataagttctgtatggctttggcagtggtataggctttgtagatttttattttaatttaatataaatttttgctttaagaaggaaatggatttagtatttgtcaggttaggagtcacctggataactcctctcctcttgtgctctgtctgctactgctgtgtcccctaagaacagaggctgctattaaagctatactcatagaaaaaaaaatgaagcattaaaaaaattcttttgtttagttcttctctgcttcgtaaaggtgggatcatattgtaaggtgcagagctgaaggagctgggcaaataaagttctgggactcaagctcctgacgccttctctttcttatccttcaagtgtagtttctaatcattttctactttgccacagctccccagtcagagctccagtggtttccaggtgagaatggaccctgacaaaagagctaggatggttgataagcgtcttttccctttagatgctgtgtggcctgatggatgacccagtttcttactatttacagtgtatgtgagcttacataaaccactcacctttctgcacctttatatccggattcttaatccaggggaatgggtttaaataacacacgagggagaggaatggtgctgttgttaaaagcattattctcaaagttggtgtttgaatcccaactttgctccttattcattgtgtaaccataggcacgttacttagactctgtgaatcttatttcctgatttgtgaaatggaggcaatatcacaccttacaacacttgaggaaataatgtgcttcaagtgattagcccagtgcttagtaaaagccttatagtttcatcattgtcaaatgttctgcatggttccaattccctgatacaacttctcactctaaagaagcacccatcatgatctcgttgtattgactgtgaagaaaagatgaacctcaaaacaatataaaatataaagagatgttaggaggagctaattacaagcaaaaagaacaatgtattttagaagtttgatttccttttttttttttcagacagggtctcgctctgtcactcaggctggagtgcagtggcacaatcttggctcactgcaaactccacctcccatgctcaagcgatcctcacgccttggcctctcaagtagctggcgtgcaccaccatgcccagctaatttttgtatttttagtagagatgtggtttcgctatgttgcccaggctggtcttgaattcctggactcaagtgatccacctgcctcgacatcccaaagggctgggatagaaaacgtgagccacagcagccagcttagaagttaggtttctgagcttattgatccaagctgaaaattaaagtgagatatgaatctggtattatttagttttgacagcaaattttaaaataggaaaaaaatacctctaaatttgtttacaaaaacaatttagaccatcagaaattctgcctgtgtttttataaaaaatacattcatggaaaaataaagttttttttccaatgtctgtataaatatgagtttatgttgaacaacgaaaggtttttgcagagcgttaacatttgcttattagacaatagaatttgattctgcccttccgtgtgtgtctaaattcaattgattgacacctcattgttagtagtccactctcactaatcatttttagcacacacagaatctaaaatctttgggtggtactttccatttcttgcctgtgctttcatgttagcaatgaaatattgataattttataaaggagacataaaatacatctgtagaacatgattgcagatgttggcagtgatggaaaggtagcagcttttgagggtaaggcaagatggagtgaaagtttggttaaggaaggcagctcaagcatattgataaactgaaggagtgcctgtggagagatccaagatggactagaagagatataactgaaaagtaagaaagtaagaaggaatagatatcagcgtggaggagaggggaattgaggaatgtgtctcccattctttggttaatttgggtgagatcatctcctaacagaagggtttgagtaggaatggccaaagattggaaaagagtggtcaagtttatttgtccctggaaatgcaaacaaaaatgtggaaaactagagataatgagaacttacatttgttcttccaactattatttattgagtatctatgttgtgctagacactagagacaaagaggtgaataaaacacaggacttccggtatcatggggcttattaaaagaagtcaatgtgcttagcctgtaattgggaagaccaagagagaatatcagttatagcaatggttgccaaacatgtgttgggtgagaggagctgcctgtctgatgtgctactaaaagacagagctgagaccagtaagtaaatttgcagaaagtaaggtcttgactcaaaataaggaagaaagcagtgctgttagagggaatgagttccttgtcattctgagcatctgtaacagagaagaagtagccattggccatgattaatagagatgattcagacattggcaggcaagttgcagtcgatgagcttttaagacaccttacaactctgtgagtctgtgaatcactgagtgtcatcacacgatgtcacttgcagaaattattgcatagattgtcatactgcctcaactgttgtcgatgtacatttattttaagagatggcagaaaccaggaagaaggttaaggtctatttccgttgaagtaacttctcttctagtttcctgtgattaagacctttacttaaaaccagccttgctggtgaaaaggcatataatcactggttctcttcagcccctgtcatgacagattagcattaataatatagagaacagcagcattaaaagtaattacaaactgtcagaaagatacaagaaatatgacatagttcatagcttcttttcaggcttcaaatattatttgaggggaaaaataattacatttttctgttcatttcctaatacaaataacttcagatatctcataattcttaaaatttgcaattaattcgttgaaaaactaatgtcaggttgaaaaagggcctctttggtcacagatttgcactgtggaatgattccttaaggtacgttcccaattgcctgtcaaggttcctattaaatgaattaatgtagaaacataaatcaactagcatttaaaaatacaaattgtctaaactttaattgtacatgtgcttagctttttcaccttttgtctgtttaaatactccaacctcttaatttaggtatgcattcctacaaatttacctaagataccagaatttagtaaaattcttcccagtgaacttttgttcaactcaagcccattttgttctagctatccgatctagtatgtgtttttctatgaaaaatgagaaaggtttcagtgttcatatcttaataaaatttataaggcttcttccacacttcccctctttctgtaatcctttcttctttattgcatgtactctttaacctgagaagaaataaaaacaaagatgaacacttgttacttctatacttattcttttttccagaggaaaaaaggaaaaaaagcatttttccctatttttaagcaccattcactacaaactagtcactaacttactatatttaaaatttatgatttaattgaatagatgtattatacatatatcttgtggtagtcatgtcatcttatattggttgttttgtaaaagcaaaattcttaacaaaatgggtgttcagatttagatagaataacttgacctcaggaactgattgtaagcaaccaataggttgaagcagacgggaataggggtgttggattgatgtccatggtctttctgcccttacaatgcctggcatattgcagcacacgtaattcccgaaataggccaaggatgtcaaataaaaaagaaggatggaaagaagaaaagaaggaagaatgttattgcattctaaatatttgttgaccttacaaagtcactattatatatggcatactctttaggtagaagtttctatgggttagcctacatactatcatgtgaagttctattttatgtttgtctcaaatgattggaatcttaaatcaacattgttctgagaaagaactaatttcactcatcagtatataccataatatgtacacctatccatgtttttttcttattttctctttagttcctctatcatggcctgtcctctttgggaaaatagttccccttcatataaaatggtttataatgacatgaatggactagatcctttggggggaagtactgatactctatctttcttattaaaaattttatattgacatatatatatgtgtatatatatatgtacatgtagagagagagagagagacaaaatcatgttaccctctgaacacaaaaagcagctccctgtgaggaaaggctttaatattccttaatgttcgtttattacacaagtcactcatacacacaaaattaggataaataaaactggatgatcacaaagaacatttaaaaatcactatctggtgatagtaactattatcaagatggtgtttcctacatttatatcttaaaacaattaaccatactgtacctgctgtttgggatgagctttgttctttcaacaatatataatgaatggatgtctttccttatcaatgaatatgcagccatgttaccatttctaatgacttcagagcattcattgggtggcttcatttaagccctctttatttaagcatgtcctatcattgaaaattcagataatttctactttgttgctattaaagaattttatgatggacatccttgtaattctccccttgcattcatttaggatcctttcagagcctccaggtgtcgttggtgtcttacagggaacagctgccacaccagagacaggatcaaatccagtccttagtgctcggtaggcaggatctgactaaattaaaaagtgaaccaaaaggatgaagctgtgagcaaagtagagccttcgggtcattttactcttttgcttagcatcttttcctcctgttatttctgcattagtactggtagcagtctatataaccctttcccaaggaaaatcatggatctcttcagccacagttacagacgtggaagttgcacttaccctaaagccctaaaagtgtgtgtatgtgtgtgcatgtgtgtatgcatgtgtgtttctatctgaaatttggaagtaatggcaaaggatccctgcatatcctttcaatgtcatgctaaagtactcactaacaagcctgcccgaggtttgactctcttgggggcagggctggcaaactttatatgtaaaaggcaaggtaataaatattttagatttagatggccatatagtccccgtcacaacgactcactctgctattgtagggcaaaagcagccacagacaatacataaatgagtgaatgtggctatatttcaataaaactccatgaaaatgtgaggcagaccagatttggcccacaggccatagtttcctgactcttgtattcgggaaatgtaattttgttttacttactatttattattattaactgacaaggtataaattagttttgtttcgaagagatgcaagggttttatatgcaataggaaaataaccacaatggttctgctgcctaaaagagacccacttactggataaagacaggtataggctcaaattaaatgggtggaaaaagacatacaatgtgaatggaaaacaaaagcaagcagaactagcaatcgttatatcaaataaagcagatttaaacgaacaacagtaaaaaagcggaaaggagggcattatatgatgataaagcgttcaatacaacaagatttaacactgtcctaaatatatatgcacccaacaccagagcgcatggatttataaagcaaatactagatctaagaaaacattgagaacaatactataatagtgggggacttcagcaccctactgatatcactagacagatccttcaggcagaaaatcaacaaagaaactctggacttaaactggattagagaccaaatggacctaataaacatttacagaacattctatccaacaactgcagaatatacattcttctcatctctgcgtggaacattctccaaaatgaaccatatacttggccataaagcaagtgtcagtaaatttttaaaaaatcaaaattatatcaagtatcttttctgaacacagtggaataaaattagaaatcaataccaggagatattctcaaaactacacaagtacatggaaactaaacaacttgttatagaatgacatttgggtaaacaataagattaagacagaaattaaaaaaaactgaaatgaatgaaaatagagacgcaacataccaaaacctctgggatacagcaaaagcagtgctaagaggaaagtttttagcattaagtgcctatataaaacagaaagatctcaaattaataacctagtatcaaacctcaaggaactagaaaaagaagaacaatccaactcaaagctagcagaagaaaagaaataacaaagatcagagcagaactaaatgagacgaagaacaaaaaaacaaaggtccagtggatcaacaaaacaaaaatttggttttctgaaaggataaataaaattgtcagactgctagctagagtaaccaagaaaaaaaagagagaagattcaagtaagtacaatccaagatgataaaggtgacattacaactgctaccacagaattataaaagagcatcagagactactgtgagtacctctgtgcatactaactggaaaacatagaggaaatgggtaaattcctgtaaacatgcaatcccccaagatggaagaaatagaaatcctaagcagaccagtaatgagtaataaaattgaattaatattaaagaagtctcctaacaaaaaagaccaggactagatgtattcacagccaaattttaccagatatacaaagaagtgttggtaccaatcttactgaaattattcaaaaaaattcaggaggatggattcctccctaacacattctgtgaaaccagtatcagcctgacaccaaagtcaggcaaggaaacaacaacaacaaaaataaaaccatagatcaatacccctggagaacatagatgcagaaatcctcaagaaaatactagcaaactgaattcaacaacacaccaaaaagataattcatcatgctcaagtgggttttatcccagggattcaaggatggttcaacattcacaaatcaataaatgcaattcaccatataaacagaactaaaaacagaaaccatatgatcatgtcagcagatgcagaaaaggcatttgataaaatccaacatcctttgatgatggaaaccttcaacaaaacaggcatcaaaaaatgcctcaaaataataagagtcatatacgacaaacccacagccaacattgtacttaatggggaaaagttgaaaacattccccctaagaactggaacaagaaaaagatgtccattctcaccactccaattcagcatagtaatagaagtcccagccagagcaataagacaaaagaaagaactaaaaggcattcaaactggaaaagaagtcaaattatcactgtttaatgatgacacgattgtatacctggaataccgtgactccttcagaagactcctagacttgataaatgacttcagtaaagtcttaggatacaaaactaatgtataaaaatcagtagcgtttctgtacaccagtaacattcaaggtgaggatcgaatcaagaactcaaccccatttacaatagccacaaaaaaataaaatacccaggaagatatttaaccaaggaggtgaaagatctctacaagaagaactataaaacactgataaaagaaattatagatgacacaaacaagtgaaaaaatgccccatgttcatggattggaagaatcagtattgttaaggtgaccatactttccaaaacaacttatagatttaatgcagttcgcatcaaactatcaatgtcatttttcacagtattagaataaaacaatagcaaagtcatggaaccaacctaactgtccatcaacaattgactgtataaagaaaatggtatatatacactatggacttagtaagcagccataaagaagccctatggacttagtaagcagccataataaaagaaggaaatcatgtcctttgcaacaacgtggatggagctggaggccattatcctaagtgaactaacttagaaacagaaaggtaaatactgaatgttctcacttgtacgtggcagctaacaatgagtacacatggacataaagatggaaataatagacactggggactccaaaagtgggagggtggaactgggatgctggttgaaaaattacctatcgggtacaatgttcactatttgagtagtaggtgccactacaagcccaatccccacctgtatgcaatataggcatggaacaaacatgcacgtgtaccccctgattctaaaataaagtaagataaaataaaataaaaataacaataaccctgatgattattccatgattgctttatagagtatttgccattttaaatatacaacttagcaaccattgtccagctttggcatcctgctggctctctcattaataagttagtaaaatttcagcatgtcctcactatttatatgagaattatgttttaagcttttcaaaaaagtatactttgcctggactccacaggaaagacgaccttaagaaaaagacttggtaaggaacatagactcagaaggtcagctcagccttccttgcctctgctgttttctgcagagatggttgtctggtttttcatttgcctctcttttgcttgcgaccagataacttactgtccccatagcatctttgtcctcaggaagctcccttctacaagggcaggacatcctcatcaattggaaggatagtcttgtgtctaaacatttgtgacggttctgctaagtacatgctgtggccagcagcatagttccaccagcaactcacttacaaagtgtaacacatttagctagtttttttttttaagtcttccacttttttttttttctgttatgatttcattctgaaaagggaaccaagcccgttgatcatctccgagtttagcagagagcctggtgcttgagggttacgctgcagcatacaccgcctcagtgattcactgtctccaccagtcactaagcatctgtgctcagcagccgctgcttgccggcactttgctgatttttttcttttgcttttgaaaaagctgctgtgtggtttctgtatacagaatttgagtctctgcttttccccggatcatctcatttgatcctcccagccagcttatgaggctagtttagtatattgccactgtttatagaggaggattctgagaactcaaagaagttaaggcacttgcctgagatcacactgcttgtaaactgctgggttaaaatggattttaacccagttccacccacccctcaaactcaagcttagccctgccctgtattgcctccccagtcccttactcccagatctgccagacctatctgcagatcagacctgtcttcattcctgggcctgtatgactgtggctggtaggataatattaatactaatattttaatgctaacactaatgttaatacccaacactaactgagcattcataaataccaggcccctttttaacaggaaggttataatctatcatccaaacagggatacttttttaaaaacaactttattggggcagttgacagataataaactataaatgtttaaagcatataatttaataaattttgatatgtatattcacatgaagccctcaccgtgatcaagatagtggatgtttctatgacccctgaaagtttccttatgcctgtttatcatccttccctatcacccactcctgttcctgggtaaccactgatctgcttcttttcttcttttctttcctttcctcccctcccctcccctcccctcccctcccctcccctcccctcccctcctctcccctgctctcctctcccctctcctctcctcttctgacagaatcttgctcctgcgatctttgctcagtgcaatctctgcctcctgggttcaagcaattctcctccatcagcctcccaagtagccgggattacaagcacatgccaccatgccagctaatttttgtatttttagtagagaaggggtttttccatgttggccaagctggtgtcgaactcctgacctcaggtgatctgcccagctggtcctcacaaaatgctgggattaccagcatgagccaccacgcttgacctgctttctgtcactatggattagtttgcattttctagaattgtctttctttctttcttacttattgatacacacatgttgtgtgtatcagtagttcattcctttatattgctgagtagtactccatagtatggatatgccacagttaattcatccattccctgttcatgggcatttgagttgttttcactttttaaatattaccaacaaagctgctatgatcattaatgtataagtctttgtatgaacgtatgctttcatttctcttggtaaatacctaggagtagaataactagatcatattgttggtgtagctttaatttttaagaaactgccaattttttccaaagcggttgtaccatttaatattctcataaatggcatataaaacatattaagtcctccacatcttcattgacactttgtgtggtgagcctttataattttaaatattattaataattacatgtagtatgatatcatggctttaattttgcatttccctaatgattaatgatgttgaatatattttcaagtctttatttgccatctatgtatcttctttagtgaagtttctgttcaaaatttttgctcatctttttttaagtgggttgtttcttactgagttttcagagttctttagatatttttgatacaagtcctttatcagatatgtgatggcaactgttttctcccagtctgtggcttgtcttttcatgctgttcagtgtctttgaagactaaaaatttaaagtttataaaattcagttgattaatttttaatttttatagtgcatggtttttatgtttcttcggagaaatacttgcctagcccataatcacatgttttcttctttgttttttctctaaatgttttaagattttaggtttttcacaaatgttccattttgtgttaatttttatgtgtggaggtagatattgatttgtcaattacactgggcttctttttccacatagatgatgatggtaatggtgaataatgatagctctacttcagtctggagagattttatttttgccttatttcactggctggaacctcttagacagtgtttaatagaattggtgcgagtgagcattcttgtctcattcctgatgtaggagtaaaataatatttaatctttcaccattaagaatgatgtaagagctttcggctggaactgccatcttccagtaattcgccaaaatgacaaacacaaagagaaagaggagaggcacccgatacatattctctggccttttagaaaacatacagttgttcctttggccacgtatatgcgaatctataagaaaggtgatatcgtagacatgaagggaatgggtactcttcaaaagggaatgccccacaagtgttaccatggctagactgggagagtctacggtgttccccagcatgctgttggcattgctgtaaacaaccccacaagtgttaccatggctagactgggagagtctacagtgttcccccgcacgctgttgacattgttgtaaacaaacaagggcaagatacttgccaagataattaatgtgcatattgagcacattaaacactctaagagctgagatagcttcctgaaacacgtgaaggaaaatgatcagaaagagaaagaagccaaagagaaaggtacctgggttcaactgaagcttcagcctgtccactcagagaagcacgctttgtgagaaccaacgggaaagagcctgagctgctggaacctattccctgtgaattcatggcatattacgtgttaaaaaaataaaagacctctggactataaaaatgtttctcttcattgagtagaagtgtggtgtcctctcccccaaagcaatatttaaagcaaattttaattgtgtcctaattcattatgtgatgtctttactattcaaatgtaatgtatttcttgctgaaagacgtgaggtagcttattgtgcaaaaaattactcaactggttagaaaatggccaggtattatgtatgaaatatttgtgctggtttgaagatagtccctctaaatcatcaaggaagaaataaaataatttacaaaaaaaaaaaagaatgatataagtaagctatgtgattttataggtgtcctttatctggctgaagagttctcttttattcttagtttactgagaggttttttttttgtttgttttaaattagaaatgaatgttggatttcgttgaatgcttttgtaatttttctttcaagatatattaatatcatgaatacctttaactgatttttgaatattaaactaaactttttttcctgggataaggcttgtctagtcatgaggtacttacacattgttggattcgatttgctcacgttgttatgctttgggatattgcctgtaggtttttgttttggagttttctttttgtaatctctcttttctctctatttcaatctcatcagagtaatgggcttcatagagtgtgttgaaaaatattttcctttcttcagttctctggaagagtttgtctagaattaatactattattgccttcaatatttggtggagtctttcagtgaagtcatctgaactcggagttttctttgtggtagttttcacaacaaatttatttaatttatttagggttatttgggtaatctagctcttcttgtgtaaactttgatattttgtgtcacttaagtcatttgcttatttcatctgttatcaaatttattggcatagaattgttcataatatttctttactatactttgattatatttagatcttccgtgatgttacttattttattcctaatattggaaatttgtgttttctttttccttttttttgtcctgatcagtggctacaaacttatcaatgttattaatcttcacaagaaactggttttggttttattgtttttctctgttgttttctgttttatagtttattcaattcgtaattataaatggatttattaataattaaaatgctgatgtttattatttcttctcttctgcttactttaggtttcatttgctcttctttttctaatttcttatggtggaagctgaggtaattgatttgaaagctttcttttttttatataagcattttgttgctatacatttttaatttttctacaagcactgctttagccacattcaacaattttttttttttttgagatggggtctccctctgttgcccaagctagaatgcagtggcacagtcttggctcactgcaacctccacctcctgggttcaggtgattctcctgcctcagcctcctgagtagctgggattatatgggcacaccaccatgcacggataatttttgaatttttagtagagacggggtttcactatgttagccaggctggtttccatctcctgacctcaagtgatccccccgactcagtctcccaaagtgctgggattacaggcgtgaaccaccttgcccagccgcgttaaacaaattttgatgatatattgtgttttcatttttattcaatttaaaagactttttaatttcttatttgattcatgaattctttggaagtgtgttacgtacatttcaagtatttgaagaattttctagacggctttctattattgatttgtaatttaatcctactgtggtcagagaacatactttgtaaaacttgaatcgttatatatttattgatgcttgttttatggcttataacatgctttttcttggtaaatgttccatgcgcacttgaaaagaatgtattttctgttgtcgacgagtgttctagaaaggtcaaataggttaagttggttgatagcattgtataagtcttctatgttcttactaattttctatctaggcagtctatcaattattgagagaatgttaaaatttgacaaaaatgccaatttttctatttctctacaattctataagtttccaatttatgattttgaagctttgtgtttaggtgcataaatatttagaattgttttgtactcttgatgccttgacctctctatcattatgaaatgattatctttaacttgggtaattttaattcctgaaatataacttcatctgatactaatatagcatcttcagctttattttggttagtattagcatgatatacatcttttcacccttttacttttaatctgtgtctttgtattgaaaatgaatttcttataggcggtatacaactaggtattacttttttatctaatctgataatttgggatttttaattgaggaatttgggctatttacatttaatgtaattattgacatctttagtgggcttaaatctacatgatagtacttattttttattgtcccatctgttcttttttattccctttcctctttttctgcctttttttggagtattttttataattccatttttatctctttagttggtttattagctataactctttgttgagttattttagtggttactttagggtttataattaagttcataattttacacacacacacacacacatatatatatagcagttgatatcttttataaagatttaataagaaaataatcagaaaaaaattattgtatttacccaggcagttacagtttctgatgcttcattcctttttctcaatctaagtctatatctggaataatttttcttctgctctaagaatcttaatattctttgtattacagttttgttggtgataattctttcagattttgtgttttgtaaacatcttaattttgcctttgttttaaaaagacatttaaaaatcattaaacaattctaggttggttgtttttcgtatttctataagtattcttgacagcttttctgaaacagagttaaattactaggaaacagtttaatccatgtaggtcttgcttttatattttgttaggtgggaccaaagcagcatttaatctagggttaattcttccttattactgaagcaagactctctttaatactctcatcaatgccccatcaattgagaagtttccattctagctgttgggaaaatccgctgttagagggtggtgttcatctgatcctttggggtggctctttcctcgtgcttgggtaagtttcttcacaggcacacattgatcagtacttaagttggaccctctaaaggtctccttagttctctttctgtgcgtccttttctctggaactcagccttgaaaattttagctaccttggcccttggcgttcctagacttccagatccttctctcatcttttttttttttcttttcttttctttttttttttttttgagacagagtttcactcttgttgcccaggctggagtgcaatggcgcaatctcggctcactgcaacctctgcctcccaggttcaagcgattctcctgcctcagcctcccaagtagctgggattacaggcacccaccaccacgcctgactaattttttgtaattttagtagagacaaggtttcaccatgttggccaggctggtcttgaactcctgacctcaggtgatccacctgcatcagccttccaaagtactaggattacaggtgtgagccaccatgcccggcctccttctctcttctttctcttctttacaccatgacttagacatctactttctctacatggtaagatagggcagttagtagaatcacctctttttgtttcacatctttcagggaccactgtcttatcttttctgatgtccaatagcttgagaatcattatatatatattgtttctttaaaaaaatttgtttcaggaaggaaatgctaattctatttcatgctaactccatcttggccagcagcagaggccaaatcaagacacttctgagagtaaaaggagaaagctccactaataattataccatgtaacaggcataaaccaaactgtcctagataagatgggacgtatcgttatcctgtatatgaagagcattacctgaattaattaatcagtgtttatagtaactttatgaagtaggcagtattcgtttcattcacagatgagataagcgaggtaggtaggagataactcacttatctagtgtttcacaggcaggttgtgggtggtagagcggggatttgaattcaagaacacggattctgagcccacgcttactggtgccgctcactacccctaccaccaccagcaccaccccatctccaacaatacacagctgggaaacgttagcattcagtgatattatccacaacatccagtttgtagtggatcctataccagctctgggcactaggggggtgtctgaggaccagctcccttcctgtctccttttccaccaatttcatgaacattctggtctctgttaccttctctcttccatcccctgtggtttgcctgtttctcctgccagttaactttaggactagactcagtgtggagtctccacattcttttctgatctccaaactggccccctctgaggaaccctgatgaaaccagagtgggatgtgctgtgtccactgggtccagggtctgtgcttctagcattttgactgagcccagtggcttccctgccaggcagctctgcctcactcaccctccacctcggcatgtgtcatgcacattacgatgccaagtatatgtcacacatgatcttgccccctagagtcattcgcagagtgatgaggccaccatggtgttgaatgggttcaggaatccatacttctcattttaattcagtcttgtcttttctatcagtgtaccagtgttaaggggaaaagccacaccaagcaggctggtttaaaacagcacactcatcattcagctgattatacagacttaggctcttttcctccaagtttcctcctccctcccgaccgaccgtcatgcagccccctttgtcccccactgcccgtcaccctctctggaggccacccacagtggtctcttctttgttctcctatctgtagtcagccaaggatatccctttgttcccttatcttgccttgttcaggaatgttatctgcattgaggcctaatttgtttcatcacctctttcacctcctcaggaccttcactccccggcttccttaccaaggtcaactctcctcatccctctcaggaatttgctcttatctatgtaacagggttgcattttattctgcgagaccacagggcaagaaatgccacattcttttccttctttaaatcaagtttaatatgaaacagcagaaaattcaatatctgtctttacctgggcttcttccactaccaatccaaccccacagtgtcaggcaaaagctcatgatgtctttgcagcacggcattttcagagaaggcttgacttggctctggcctggacaggttaccaattataggcttattgtcccaaccttgctgttcccatgaaggccaaacctggaggattctgtgccacgtttgagtgtggtactgtggctgtcggggataaatcactaactgtttaactcccaccccagccactgacaaccaggcatagaccagccttcgtttgtgggaaccccagaggacttcatccttgttgtcttgttggataaatatctcccttccctgtcttagtaattcaggctgctataacagaacaccatagagagggtggcttaaacaacagacagttatctgtaatagttctggagtctggtgtgcaccccaaatttctgagacaagactcagtcaatttagaaagttaattttgccaaggttaaggacatgccagtgacacagcctcaggaggtcctggcaacatgtgcccaaggtggctagtgtacagcttgcttttataccttttagagagacagaatacatcaatcaatacatggaagacttacactggttcagtctggaagggcaggacaactcaaggtgggaggaatgtctggatttcgagaaggggttgtggagacctaggttttatcatgcagaggaagcctccaagtagcaggcttcagagaggatagagtgcaaatgtttcttatcaggctttaggtttgtatcgatgttaatgctggtggagtataatgaggcatgtccaacccccacttcccatcatggcctgaacgtcttgcaggttaaattttaggaagccctggctgaggagaggattcattcacatggtttttgggggtggaatgggggcctgggagttttattttttggtttactctgggaagtataagatcaagatcttggcagattaggtatttggcaaggaccttctgtctggtttgcagattgcggtcttctcgtctttttcatgttctcacatggtggagagcagggagggaaaagcaagctctctcacgtcttttaataagggcactaattccattcataaggattccatttcctgacctaattacctctgaggccccactttctaataccatcatattgtaggttaggatttcaatacatgaatttggggggtacaaaaccattcagtccatagcatcgcgttagtttaaattgcttgtaaaaatccaaaaagcattcacttcttctccctgtccaatataatccaccataacatccttcagagaagcaaggcttttgagaaacaaatagctaggaaggactttatttcctctgcctggcaagtttgctttcagctctgggtcacagaaacacacctgaggcaacaacacacaaagacatggcgtcttttctgagcttggcaagggaaacgtaacttgaagtaaggggaaaaaagcacacatttatatctgaatactgcagtttctaccacttgttaactgtgtgacactggacatctaaaaactgaggctcatgaaaacatctgccatctgacttcttagggttgttttgaagattaaataagttaatagtgtgaaaactgcttagaacaatgctatgcaagtgttagctatgtttactgtcagctaataatgctgcttgtgacattttgtctgtgctccttgtttcaaacatcttacttggagcttccaaagttagcacttagagtggatattaggttggtgcaaaagcagttggattttttgccattaaaagtacaggcaaaacagcaattacttttgcaccagcctaacagcttatgtatgcagaattacctgcaaattcctttggagactagccataatatttcttgctgtgtctaacccaggcagttttcctcccagctttaaattcacttgtgttctcttgggttggtctcccagtgaaggtgttgcttgcagatttatacctctcctctcacagccaatctggagcaggccttcatttagtgaaaaactgcagaatcatccatgctgcttattttttttctgtctctctctctctctctctctctgttgagtatacatagtggaaatcatataagttaaatgtgaatgaactctaacttgcagttttcctaaagtccatctcatcctaagcctagctgaatatgaaattgacatccgtttctatttcagggaccttcacgatgccattggtcacatagggcagagaatgaggagttcagagattcccctggactgccaccattggtatcctcatgatgttcccaaaggcagatcattttgctcttcttttaggaaatagtagtaactgactgacttcactgaagtctcctttctcccttgtcctaatccttagtgggtacaatgagtcctttacctggggcagtagggtgtatgtattaggattccaggggatgttcttcatccctggtggcagctatgcaaggaatattcaaccgtatgtggctgttgagcatcacctgtagtttttgtttgtattaagatatagtcttctagatcaagagcagtggctcactcctgtaatcccaaagctttgggagactgaggcaggaggatcacttgagcccaggagttcaagaccagcttgggcaacataagggagacttcatctttacaaaataaaaaataaaataattagccagatatggaggcacatgcctgtagtagcagctactcaggaagctgagctgggaggattgcttgtgcctgggaggtcaaggctgcagtgaaccacgatcacgccccttgactccagcctgcgcaaccaaatgagatgctgcctcaaaaagagaagaagaaaaaggaatgctcttctaaaagagatgacacaggcaaatattagccacatacacttgaacatgggaaaaattaaaactgagacaacaccaccctggaccaggtaccccacattttgtttttctccctcctctgtcactaatcaactagatggtctcaggtgagccccgtcccctctctgaggctcagttttctcatctgtgagatgaggggttgtgcatatggacttcccagttctgtcatcctaaactctgtgattccacttgatcagtgtgaattcttccttgaaacctttccatgacaggaatggctttggggaatgcactggagaatggtgttgtttcttaggaaagttacctggtggaggcggtgtagtaattttagtttcctttgtggggaccacttctgctgtaatctttatgtatgttatgggtagggttgaatccaccacctcagctccaaggaccaatccatcctctttgtcatggtgataagttcacgcataggcatgtgacccaagtggttcaatgggattcactcctgaaagtcttgttggaaactattagaaaagagtcattgtcttttcttcagtattggtacactggtacgcatagagttggtaatggccatccttgacataacatggagagtatgtccaagaaatgaggctgatagacacacgcatagttacagagagacagaagcatgcagaaacagagagatattatactgatgacattgttgagtgccttgatcctggcctttccttttgggcttaacagtaacaagagtcactaaatatcctttctgctcaaaccattttgacttaggattctgttatctgcaaatgaatgatgcctgcctaacaggggtgatgtttccattgcaatgttgggagaagaatttgcttccctctagatgccatgaatagaggcttagaaatgagagaagggagtataatctcagacagcagagggtagcatgggaatgggaaagggaaagaccctacaatgtgctgagcagtgtgctgcacgtttcattttttttccacatttaactccataaccctatgagaaatgtgttattttcattatgcccatttttcagagaaggaaactggagatagaacagattaaggacttgcctgaggtcacacaatcggtggcagagcagagatttataaccagactcatggtctcctgagcttcagctcttgaccactgaagtatagttccatggtgatttttccccctaatttcctgcctagcttgccacctagctgaagtggggctgtaatgtgaatcaaggcctcctggactcccatacatgtgtaagagagatggaggagaagtacagacaggggagatctctaagtggacaagtcctgtggctaaaacaaaatcctggaaggtgactaccctccacaccccaccccacccaagccagaaaggaaaagattatccaaagataattaattttttaaatagatacttttttgcaaatttaacagaattgtgatctatccatgcagttttaaactgtcaaatgatttagccataaatttcgaaatgagaatatatagcgtataaccacatcaactttttatgaaacatattgaaatttattagttatcaatgcagtgtgtttcagcatatctttttgggaaatcaaatatatcattttaatattttcttccacatgcagtatacattaactcacaggatgctgaggctgcctctgagaatttctgtcatttccttcttgtccttttttccttctctccttcatctgctgtgcgtttatctttatgtgctcccttccatttgactgtacagaaaagctctatgaagggaatctggttataaacctcagccctgcctcctattgtgtgacctcaggcaagtccttaatctgtttcttctccagtttccttctctgaaaaatgggcataataaaattagtacctttctcatatggataggaaattaaatgtaaaatatgataaactgcacattagctgttttattttttattttatggtgccttgtacatagtaggtgctcaataaattctgttaagttaatgcattataaaatatttcagtttatctcattataaataataaccaaggataagtaattttaaaactaaccttataaattgaagttaatatacatcttgacaattgcataatttctaagtgtacagctggataaattatcacatattaaatgcacccatgtaatgaccactcagatcaagaaataaaccgttactagctttccagtagccctgacttttgtttcccccagttcactacaattttgacttctacttcattcatcaattttgcttgtttttggacttaatataaatggacccatacagtgtatattctttcatgtcaagctttttaaaaaggtaacatcattttttgaaacttatttatataatttattatagcagtaattcattcctttttattgctgtatggaattctatttgatgatacaccacaatttactcattcattctattgatggacatttgggttgtttaaagggctttttttctaccagaatatgcgactatgaacatttttgtttcttgctaaacaatcccatcaaaaagtgagctaatgacctgaatagacaactcttaaaagaagatatacaaatgaacaacaaacatatgaaaaaatgctcaacatcactaatgatcagggacgtgcaggttaaaaaccacaatgtgataccaccttattcccacaagaatggccatcatcaaaaaatcaaaaaataatagatggtgtggatgcagtgaaaagggaacacttctacactgctggtaggagtgtaagctagtacaaccactatggaaaacagtgtggagattccttaaactaaaagtaggactaccatttgatccagcaattccactactgggtatctacccagaggaaaagaagtcattataagaaaaagatacttgctcacacatgtttatagcagcacaattcacgattgcaaaaatgtggatctagcccaaatatcaatgagtgtataaagaaactgtgatgtatatatataccacattatatatatacatatatatacaccacatttttatatatatatatatatatacacatatatatatgtatatatatatataatggaatattacttacccataaaaaggaatgaattaatggcatttgcagcacctggatgggattggagactattattccaagtccaagtggagttaactcagaaatggaaaaccaaacatcatatgttcttacttataagtgggggctagtctataaggaggcagaggcataaggatgatacaatggaccttggggacccagagggaaagggtgggtagtgagtgagggataaaagactagaaagtgggttcagtgtatagtactcaggtgatgggtgcaccaaaatctcacaaatcaccactaaagaacttactcatgtaaccaaataccacctgtttcccaaaaacctacggaaataaaaaatttaaagaaaaagaacatttttatacatgtttattgggatacataggcatgcgttttttgggcttatgtctaggagtagaatttttggttcactggccatgcacattttcaatgtgggtagatattgccaaatagtttttgaagtagttatgccaattcatattgtcaatgctccacattggaagaccactaggaatacatttgtagtggaaaatgaacaaatttaggttcattaattcatttcaacaagggagagcacacacgaaggggatggtgagacgtctcaagaaaagggtgttgggaagaattaggagatttgggcttctgttaggtggttttgggagggttcaaggaaactggactttgatcttacttggatactctcaggaagccaggttaattctgtgactggatggcttaatcatttttatccagaaagcaggaagaatggaatgaggctaaactggaatttgaagagaagtagcattgacttacataagccaacatattaatttcctgtggctgctgtagcaaagtactgcaaactgggtggcttaaaagagcagaaatttagtttattttctcgcagttctgcagactaaaagtctgaaattaaggtgttggtagggctaattccattttggaagcactgaaggagaattaattccatgcccttctcctagcttctagtgatggctggcaatccttggctctccctggcttgtaggtgcattgctccaatctcttcccctattgtcctatgatgtgctctctgtgtctgtatctctagtcaatttcttataaggacaatagccgtactggattaggtcccacactaatgacctcctcttaacttgattgcatctgcaaaaacaccctattttcaaataagggcacatgaacaggcactggtgattaagacattgacttatttcttgaagggataggattcaacccataatagctgaaatacagtgtgtttggttgcttttgtagcttgaacactgttcttaattttgtctgtgttcagatgtgattatggaggggtctcattgtgtggtgtaacaggaaatatgttcaatgggagaatactatagcctagcttcccgtttttggggtgacttttctctttctcagtagcctccactcttggtattgtcaagcttgttaatttcagtcattctggtcagtgtgaattgacatcttattgtagctgtaatttgcatttccttgatgacattgagattgagcaccttttaggattctgggggctgtttggatatgcttttttacaaagtgtttgttcaagtctattgccatttctttattaggctgcctgcccttttcttattgaatttctagagcttttaatatattccgaatacaagttgttaggtatatcgtattggtaatatcttctgctaaaccatgccttgtctttctatctgtttacgtgaaccagagggatgagaacattccatcaatggtatgtttttactttctttcatccatgtatcaggtattgtatagacacaggcataggccatgagttcagcttaccatgaactccctgacctcaactcctgcttctctccccatgtccaccctgctccagccgtgcttactgctgcctttgcctggaatgttctttccttagataatctcatagcttgcacacctccctaactcttctttttttttttttttttttttttttctgagacggagtttcgctctgtcgcccaggctggagtgcagtggcgcgatctcgactcactgcaagctccgcctcccgggttcacgccattctcctgcctcagcctcccgtgtagctgggactacaggcgcgcgccaccatgcccggctaattttttttttttttgtatttttagtagagacggggtttcaccgtgttagccaggatggtctcgatctcctgacctcgtgatccgcccgtctcggcctcccaaagtgctgggattacaggcgtgagccaccgcgcccggcccctaactcttcttaatgaggacttccagtgccacattttaataattgcatgctccatgccttacttattcctagaaatctgtctatcttccctgcctttcctcatatcattccttgccatctgacatatgacaagtatttgtgtactatctatctcctccagagagaatgtgagctctgttaggacaggttttgtttgtttggttggttggtttcctgctgtatgtctagtacttagaacaatgcctgcatataggagccgaccagtgaatatctattgaataaacaaatgaatgaaggaaggaatgaatgattgaaatgaacaggtaggggtggaaccatgctgctcatatgttgctgatctaatgtgggactcacagtccaatagagagtttatagaaactagttggtggctcttgtgtgatattcaccatgcgtccggtgacaataggattatactctgagatttaagttttaaaattaacatataatggatcttaacaactgtaagagaagagatagctcccaggctgcaaatcacctcagcaaactgagatcaaatgaataagcatatctaatgaaaaacatgttggtcaaaggaattttaatctgttcatgaaagcaaagtgaaaggagaatcttggaggcaatttttggcaatatccacccagactctgtccaggagaaaggggcattgccagccaacttggaggattctggacccattggcaagggcatccctcctggagctggttgaaggcagtaaggtcagttggctttggtcccttggtgaagccatcttcagagtgtgtttgctgcattaggttatcttgtgcgatgctcctacaagtccaatgccttgtaattccactaagctttcaggtaaaataggtttgggcctccttataagtcagggtctgggaagagagtcaactcattgggagaacttccaaaagtttctatgccagtcatttatcattttatgttaataaaattgatattgaagttttataacaagtctcatgaggtcgggtaatgtgattccacaactaagaaaaggagtagatcttggtgtgctggaaaagtcagctttcagaacctctaagattgagggctcagcccctggggctagtaaaaccatcagaggaatgaattccacttcatgagaacttttgacacatagactaccagtttcttggtggttgacctgcacttgcactgcggagcctatggccatgtttccagaaatttcctttgtatggaacatctgatttttacctgtactctcataagacttccttgctggtgagctgacgttaatttaagaattttagctctttcagtcttaggtatcatcaggcatgtcacactttctgtacatttgccttttgtagctagggaagctgtaaaatgtttaggccttaggtctactgaagactaaccaatgacccaatgtaatatttttaatttgtcccttgacaactttatgttgagatttctaatttccttatcagatacaaggccacagtaaaaacatcacctgttaggtcaagtctaaactggaatctatgtcatcaagctgccgtatttaattaccaatgtccataggcgttgtggttcctgattctattcctcttacaccctcttgaaatcagctccatgctgggggtttctcatactacacagctgggaattctaggattttttttttcttgccttctgtatatttctacatagcaagctgtggtcaagacatcttgctatgtggccaagatggggaaaagggactgagatagacaagtactgcaatatttgggtagtgagaaccatcacatactgcaatttttgggtgatgagaacccagcaatgcacttaatagactgctgaggggaggtaaaggccttgctcaatcaacttaatgggagaactgaacatccaaagattgtaactaccatttggggacttcttaacacttgacttcattaaaattgttcagtaagaagactgatgttgccaccatgtttatacatacagtttttaaggcaggcatagagagggttacattttgtttaatagtctctttagaaaacaaagaggtagtgtatcatttagaatgcatgcagctgccagtaacaaaatacccaagtaatagtgggttaaataataaaggtagttaaatatataccataacaagaagttggtttcacagttcagggaggtaggaggggaattcatcatctctaagattattttttggcctttacttcatggggatcaatggttgtcacagcttcaagcatcgagtcctgcatcccaagcagaaaggcaggaaaacaaaaagactttctttctgaggcactattgtttccttatcatgaggaagcttcccagcaggcttctccccgtgtctcagtggacagagtttggttgcgtgcccacttctaggccaattgatgggaaagtaggaaggagttactgcagtggtttaggtcatcttgaagctgtgaagaggtctgatgccttccctgggatgacatgatacctgctctctacttcagcaatatggggtatatactagctgggggagtgaaaataaaaatgtcttccacatgtatattttaatcaattgtatgaacagtttttttaaaattagctttaaatgtgtagagataagtgttaaataaattcctcactggaaggagagggaggagtgggtgagtttgatgctgggatgggcaggtatgcaggtatccaggtagaagcttggcatcaatttacctgtctctaggaagttcctatcctgtttcctccggttagcctgtatctgggatataaaaatctgctgaaacatcagcctccgtgaaccacacagcatgacttgttacatgtcacagatgactgccccttgctggccaccaaacttgaaccattccgtgcagccgctgcctgttgtttcctgttatgttgttgaggtagcactgccaagttctaaacacatgccctgactccacccagagtggcacctgcacacaaaagcaatgcccagggagtgccaggccgaaataatttctgcagagttaaactggagcattaagtggcaagtggaatttgacagaggggaggagcaaccccactttctgtaagaacatgaaaaaaaaaacccacagttattaaataagctggggaaagaacaaaattacacagggatgaagaaaagtctttgcttagcgtggctgaaaaataccgacctcacagatggggtagggttgcgctggaggtagagcaatgtcagcaataaagagagagaataaaggaaggaagtcacggccagcttgcaaaaagttgtctctgttgtctgttctgtgaaaccgcttgccaacaacaccgttaaaatgtaggtgttggtgtgaagatccaacaaggtacattctctgagtctggagccacttctaaaggagctaaataaaaatgaagcaattaattgagacacattgtataaaagaaatcagtgtaataccagatggaaggagtcatgtctgcaatcttagtggaaagagcattatttatcgagcattgaccttctagtgtgagcacaatgcattcattatctcatttaattcttacgattaccagctgaggcaggtgctttcattatctccatttgacagatcaggaggattgtagcttaaaaggcttaactcgtaagtggaaaggtcaatatgtagaccgaagctttctgaatccaaaatctgtgttcctaacctctattctgtactgctggccaaaattaaaaatactgaagtgtgatacaaggaaattataactctgattggatgaactgaatactagggtttgtctgttcttcagaagtaagatgatggtgtggatttaggaatacgtattatggactctattgtaagtgacagattcccgccctaacgtggctctaaaaaaaaaaggaggacatggactcctgtggtcagctgaataaaggcaccccaaaatgtccacatcctaatccccagaacccatgaatatccacatcctcatccccagaatccatgaatatccacatcctaatacctgaaacccatgaatacgttgccttttatggcagaaggggctttgtagatctgattaagtcaaagatcctgaaatggcagagatgatcctggaatatctgggtggtctcaacataaagaaaaggatccttataaaggaaacagagaggtttggttacagaagtaggagacaggaggatggaagcaagagtttggagcagtgttaggaagggccccgagccgaagaatgtaggtggcctctagaagctggaaaaggcaaagcaacagcttttgccctagagctttcagaaggaacacagccctgccaacatcttgattttggacttctgacctccagaactgtaagaggatacatttgtgttgttttaggctatccttaccgttatcgtggtaattttttacgccagcaaaagagaactaatacaactcctgtacctgaaaagcctagggcagcaatggcttcaggcttggctgggtctaggagctctaatggggtggccttgatgctgtccctcctcatgccttaactgctttcttttgcaatggccgtattcactgatgggctttcgctgggttgtggccaagctgaaaacagtagcctcaggcttttgcctcaccactggagcaatcccagtagcgcaaactgcacccctttcctagtaatgtctgcaaatgtcccagggctgacctgcatgggccgagcttgtgccctgaatgatcaccatgattctgattggccaggtctcatcattgtgtctcaaggtaagcgggggatcagccctacctgaacctcagtgactcttaaggtagaatggtgctttgcaaaggaaaatccagctgggcatgcaaaaacagcagatgcctaccagagggtgtgaggcaggagcactgagacttggattcttgcaggttctaagggaagccagagagacagaatagaggtttctgtctcaccagcagagacagtgaacaaaaccaaaaaaccgttcccctccatccttttgtggttcctaagtgtgatgattgggttttcatactcatgtgtgaaatgtacctccctcaagccttgttatgatgtggcgggcacattacccttacccatctgatgaaaagaaaaggaaaaacaaaaacttggaaatcagttataggcagcggttatggggtgaattcaaggtcttgttgcgatctgatggagaaagacaggtgtgaaaaggacaggaaaataaaaaggaaggatcccttgcttgctggatgggagaaacaagaggaccatgagaatgatccctttggataaatgtgacctgatgacacctccagaccctgagctccttcctggggtaggcctggctgtttgccgagaacagactctgcagagcagtctttgcaccccagcggagctcagtctgctctgtgagtctctgcatactactggaaaccccgacggagagtcccagcctttggaattccctcactgaggccgagattgagcagtgctcaccttctaggccaccacccttcacccttgacattcaccttcaaaagtgagctaagaggcagatgatatggcggcactgtggcaggtacaccccagagccagtccatctagagtattgttccatgtagctcacagagggagcctcaagtttctacttcttttattcttgcccccaagtaagggcatctctgttttggtgcttataactgaacaggatggacactttggcccccggttctaaaacccagtcgcgttttcctgatcctttagaagtatgagtcagatcatgccatcctgtgttcacagatatctgatagttctttagtcctctgagtcaaggccaagtcctaataaggtttacttcatctcacatcagggtgccctctgttgactgacaccctcacctgttagtcttaccttcaggtgatacacaacagccaccctggtcttatttatttaatttattgtctgtctgttcctgcttcctactatcagacaacctttgtgaggccaggaatttttgtctgtctttcttattgccatgttctaagcatctagaggaatacctgcatgtgttaggtgctcagtaagcatagactgagttgaggtgatgaattaactcaggcatgtgtgcatgcatgcatttcaccatcacttaccaagtgtgtgcaaagcaccagctaatgaactagaagctgcattcagcaagacaaactccacatggtctctgctcttgaatagctcctgctctagaggagagaatggcaatcccatgtgataattactaaaaggttggataagcccagggtactcaggggacatggggaagacaggagcgcaccagggccaagattccttcctgcttctgtatacataattgcatctcaagcctctctcaagccttgttttgatgtggcaggcacattacccttacccatctgatgaaaagaaaaggaaaaacaaaaacttggaaatcaattacaggcagcggttatggggaatctaacacgtaattgcgattttattgtttatgtcccgttagaaccatctctaggtgtacacgctccctttctgagcaaatgcattctaaatccaataggtttccctgctgccatgttgagttctaactcatgggtagttaaatcccagaatactgatgtttgctggtggaaaattgccgtttcctctccttgctgagaggaggtggaaaaccagagagcattaatattaagtaaaaggtgatattgagtaaacggtggagaggcatactaggtgcttctaagcccaatccccacaggtagctcgtgctgggtggcagagagcgagtgtgctccccactctggaactgacacttactctcgtctgtgccaggctcgtcccacagctatttggatggccactttcttctgattattcaagcctcaattttaacataagctccttagagaggcagtccctgaccaccttatctaaaattgttgccctccacatcatccttgtcattttcctcatatcactaactataatctgaatacatcctgcttcctgtctttctcttttatttaaagctaagttctatatggacagcagctatttctgtcttcctcactgttgtgtcctcaatacacatagtaggtgttcaaaaaatattcatgaataaacagacagcaaatagaggggatacttgagatacagtatctaaactgttggaatttgtagaactagaagacgccacttttggctgttttttttttttttcttttcttttcttcttttttttttttgcacctgaggaaggaagcagcttaattgaagccaccccagcagaagaatccacaccacagtcccacctcaggtggacacaccatctactactcttgctggggagagctccaagctcctgggtcgcggtggaggtgggtggcatgccttgagagccacttggagccaccgcctcctgactgaggcagtgccctcttgtggcagctctgtgatatacacacagtccttccaggctccccagagtttcctgatagtttatgagacacacccttctctttgcaccattcagctccttctagaggcttattacagattccactgggaccaaaattgacaaacgccaaaaccactatgaattccaggaatgaccttaagcagtgtttgatagttctgttagagccagcaactcattttgaatactaaattaccactacagccttgcagttccagtgcataccagaatttccagcccttctcatgtgtattgcttccaagaactgctccaagattttagccctgtgttcttttataaagtttacttttttattgagctataaccttcacaaagtaaaatgcatacatgttcagtgtacagcttaatgacatttttttttgctattagttttgcctgttcttgtacttcatgtaaatatcatcattcagaacttttcttgtgtgtctatctaaacatttcaagtcaatattttgtctatgatattcagtggcttattcttttccattgctgtgcacttactaggtgacaatttcagacaatagtatgagcacactgcaatttattcattctacatttaagacattatttagcttgttaccagtttttgtgaataactgaacattttcatacatatatttttgtagactattcatataaccaggagaggaattgctaacatattttagccttgataaatactaccaaacatttttccaaagtagtgtatcaatttacactcccacctgcgttgaatgagttcctccacgtcttcatcaatacttggtatcattggtcctttaaaatttagccattctagtatgtcattgtgcttttactttgcatttccctgatgactaatgaatttggcacattttcttatgtttatcgaaccttgcattttgaataactacacatttattgaccagagcatgtactcccctgaagtttgtagactgcctttggacctgtcctttttttaatgaaactttctctatgtttcccatgggttgtagtcatcactatccatatatgaatgtagactagaaaccttaaatctgtctttccttcgccactgtgctcaagaagtcacaaagtcctatggacccagaaatatctcctgaatgtgtttgcttctcttcattcccattgtgatcaccttagttcaattttatcatctcttgtccttactagcaggagaatgtcactctccacattcccttacttgaagaatgggttccatttttctgagaatgttttcttctttgaatccacaggcaacacaactagagagagaaataagaatcatgactactaacatctttagaatgtttagtgtctttcacgacttttacaagtttattatatgcattatctttgaagtaggtactctttttttttttatacccccatgccatcagccactgcctcgctacctgctgatggcagctgtaggcacccagctctctgcattctaggggtgcacacaccaggaagctaatgtgggccctggatttctttttttttaaatatactctaagttctagggtacatgtgcacaatgtgcaggtttgttacatatgtatacatgcgccatgttggtgtgctgcacccattaaatcatcatttacgaagtaggtactcctatcatcccccttccccagtttcagataaggacattgaactatagaggttaagaaaccacaacaagtaagctacatggttgagctggagttcaaaaccagagtctgtcttcagaaccaactgctttaccactctatgatatttgccggtggtacttgattgaaagttacaagctcatatttaattaacagatttcatttttctacataattgtggtttggagatttatagttatgccgctgggaatgaggcggatttgacagctgccatcttggctagagaaataatctctgcatttggaaacatggcggtatcaaggccagtattgcaggtttgagcctcttcctagccagttagcttccacggaggaaaacaattagtgaggactatgaatcacaggagaaactggacaaagagtgagggtggatccctataaaccatcttcaccactgcaggtgctgctgacgatagggcttctgtggtttataaccaagggggacaggtcctgctggagccagcagcctcaagagcaggtgaagcagtaacaagcactgttcctctgttgcaagtttcaagtgggtcttgaggaagtcaaaaccgtgacagcccccaggattaatcccaccagggatacaatgcaaaaactaagatccactgggcaattacagtgtgccaagcactaggctgagtgttttatggccacaagcttatttaaaaatcacaataaccttatgagagagctactgttgttatacagtagccagccgttatccaggggagattcattccaagacccttagtggatgcctgaaaccaaggatagaaccgaaccctatacatacatatttctttctatacatacacacatataataaagtttaatttacaaattaggcacagtaagagattaacaacaacccatactaaaatggaataattataacaatatgctgtaatgaaagttttgtgaatgtggcctctctctctcaacatctattttactgtattcctgcttctacttataatctgtccgtttcataatcagtgtgactactaagtgactaatggccaacaacatggacagtgcggctacgctggacacaggggagattcacatcctgggcaggatggagtgggatggcaggagatttcaccatgttattcagaatggtgcgtaacttaaaacttacgaattacttgtttctggaatttttatttaatcattttgcactgtggttgactgcatgtaactgaaactgcagaaagtgaaaccacaaataaagggagactgctgcacccattttgcagatgggacctcggagacctagagaggttaagtaacaagtgctaggccagtgcttctcaaatattaaggagtttataaatcccctggggacctggtggaaatgcggatactgacctggcagggctgaactgagattctgcgtttctaataaactcccaggggatgctactgctgctcgttgaggtgccacaccagtaacaaggccccgctcctacagctgataagtggtagagctgagattctcttacaggcgctaggggtcccgggctttctctctccatcaccctgctctattgtttcctgtagcagctgtgacaacctcatttagatcacgttcacaggtcaggccctggtaagcgttcttgtgaccttgcattaaggctccacagtgctccccctccctctctttgctccagacccaccagtcaccttgccattccacttgccacctgcccttgcccttgctgttccctcctgctgcaatgttcttccccatgcatgacaaggcttgtcccccaatgcctttctggtctctcctccagtgtctcctccttggagaggatgctatctgcagtagcttccactgcctctgcagactggcccttttcccctcttacccttttcctgttctaagttttttacagcatttatcacaataagattatacatttaatatacatatagtttattgttaattatttggtttcatcactagaatgtgagctccatgaaagcagaactttgtccatttttctcacttttttatctttagcatcttgaacagtgtctgcaacatagtgaggcttaattattatgtatgaaatgaataaatgagattgtaaatgaacgaatgactgaatagaataaatgttctaacttcctaatatctaataacaacagaagcacctaacatttactgaacacgtacagttccagaaaacacaccaattactttacccagatgatcccatttattcttacaaaaactcttagacctgttattactaattccaattttcagatgaggaaactaagactcagagaggtacactaatgttcccaaggtcacacagcaagtaagtgacagaattagatttttcagccagatctaattcccctaaagtcaacagaaagtctcctgtgctgggcaccacaagagatagcgccattgtttccatggcaacaggtcatgtcagtaactctgatgcaggatcaagtgtaggaaaacactgagcttggagaggaggccctcatgccgcaatcacaaatatttaaccaaggtagaaaaagaacaaaggaaaatgactggcttggtaaattaattcttactttctctaccacttttcgttttcatccaataagcctactcctggtcaggaaaagtaattccacttgacgtttgcttttagttttacaaaaatgaccttgcatatgtgaaaggacatattttgtcgtcaagaatatgcatgtttaaccccagcactggggggtcacgctatttctttataggaggcgtgttatcttagagcagaaggagaaaacagggagccaggattgcattttgcacccagtgccctcagcaatttctggtgcattgtgaacagttaaataggaataacctctgcttaatcttggaagcaggttagtgggtttatttaatcactgacaaaagagtatattttctaggtggaaaggagagtagagagggtttgtgacggactggaacagcagagactaggatttaagctttgggtagctccaattacacaatttgtgatgctttcacatgggtcaacaatgatcctgaaagtcctgtatatctggggagagagctgcatgctcttccttgccagtaatcagagacatctccttgtacctaaacctcccatgttctctgagctgctaagttagttctgagtcccccagagttctactggtgttactacttggcccaagaaactggggatcactgaggtttttcagagtatttttctcaaaggcaaagaatccagattaaggactgttgaggctcctataaggagctgaaggggagaagcacagggtaaagccacagtgatattcatggctatattcttggaggcctgtttgcatttgatttgtgtgggtcatggaggctgactccagtctaacattcagttgttgagaggggtagaagttctgaacaatgaatgatgtttatgatactattaataataaaactaccacaacaataacaacatagaaaacacattgagcctcccaccctcgaatcacctccctacctccacaggggtacccaccaggtagagagcccaggagcctcctgtttttagagtctttaactccattccctggccaaatgggttgttcctcattgcagcaggaaatgaatgggcacgtttaaatcaatggaggatgtttaataaaggggcaatttacaagtgtgtgggcagggtgtagggaaaccataagggatagttaggtgactgagggtcagcaacatcagggctatttcacatcccttggtcctcagggataagcagtttattgaaacctgagagtcttgcagacagggtctccttgaatcaaacttggccttggggaagagcatcatgagcagactctgctggtgagagagtcctgacctcatcctcttcctctcctttagtaccctgcccgggctctccactgcagacccaaaacagaagccaaaggcgaggaacagggcagggattaggtggcaagggatggagagtggttctgcaggggccagtggcagagtcggcacactaagggagacggggccagcaggggactcctgccctgaaataggtttatgaagtctgtctctcagaaattcagagctaggcctgagaatcaaccagggagtgattctgggtgactgggaattattatggttgtacagtattcagaagccatatgaggtggtcacagtccactatgtggatagtcagagaaagccagtgctcagagaagtacgaaaatgtacagaaagaaacagaaccattgctggatgcggtggctcacgcctgtaatcccagtattttgggaggccaaggcaggcagatcacgaggtcaggaatttgagaccagcctggccagcatggtgaaaccccatctctactaaaaagacaaaattagccaggcatagtggcaggcacctgtaatcacagctacttgggaagctgaggcaggagaattgcttgaaccctggaggcagaggttgcagtgagccgagtccagcctgggcaacagagcgagactccatctcaaaaaaaaaaaaaaaaaaaaaaaaaaaagaagcagaaccatgcaacagagaatggacacccaggtcctgcccatgacttctttctgcagatggtgcatgccctgcctctgagttctaccagatatccctcacccttatgatacacttcccttcctgcttaaacagcttcagtggaattctgatttcttaatttttataaataactgccatcttggagcatttcctataaaccaagaaatgggctgagttctttacaaacattatccaatttcatataatcctatatgatgccacttttccaggagcgcaaactgagccttggggaggttagtagctcacccaaggggagacagccagtatgaggctgagccaggacttgatcccagatctgcatgactgtaaatcccaagcttgtggccatttctcccttccgcaatgggaagagtcttcttcattgtctctcatgctggtatcaggacatcggtaggacgtccatatgatgctgcgactgcacctcgtagctttgtattgtgtaccagccattcaggccttccctcacctcttcttttgcatgctgagccctcgagttgtgtgggggctggttctctgcgtgcccagatctattttttgccctcgtctactgtgccctccatgtcccaggaagctgagcccttggactcctctggcctccactgggattcggcccttggagaggcactggcaggggccaggcaggaggggagagtggtgcacttctttgcatgtgcccttgtgtgccagtgccagcaggctcttacagcatggtttgctccccatgccctttctgtcctagagacaaaatggcttcctctggttcctgtgaggctgctccctgggtgcctcattatcccttgttagttcctttaaccctgccctcacctgtaaacaggcccttccttcaattcctttcaggatctaatggagtgtgtctgtttcctgcaaggaccctgtcctataaactgttcctgcccatctgcgaatgtccaatcatgtctttaggaccgcagatcctgaaacaggaagctgagtttactagggtcagtccactaaacacactgacctcatggttgcagacccaccgaatacttcccttccagtttatgacagcccaggcccaagtccagggccccgagcaccaggcccagcagggctgtcagtgattccggctcaggacatgcagggaacagttttcttttcagagtgctccttaataatgcacatgacagccatcacaacgtctcgcaaagcccagtgacaactccctggatcgctctgtcattacagtaatcatttgaatcaatagtgtagtaaaactgccatacgtttacttcacccgggagattaagcaaacaattatatgaaacattctgcagaaaacccagcgctccagatgcagagggagactgtgcgctcgtccccaaccaaatgctcttcctttagtgcgtttgtttttgcggctttatcaacagactctaaattctcacattgagaaagaataaacctatacatttgccagcttttttattccagcctggggaactcaccctgtgtgagtgagggagtgagtgagagggtatgtgttgtgtttctcaaacatcccagaatgtacagtgcctacatcaccactctaaacatagcagaaactcaataaaagcccacgggcggtggccgtggcagtcatggtttaaaataatgactatggcgtgatttctgagcatgacgggtttctcccggtaatgaggctttacatcttttggccttctcttttctgcacattgagccacaccaccaatttaatggatttgaaacatccattgtgatggttttattttcatcttggtcagatggacatgcagctgagagcatctcaagcactggaggcagcattaacttctgggggccaagatttcctctctctccttgttatctggatggttttctaatgtacactcgcccagtagtttgaacttggccataattacagtcttattatcctcaccagctttacttatctcattatctcctccctcctgtattagaggtcagtagaacatcccttttattagccacttaatccttctatctagtagttcaaccctgattgatccacttaaggtccttctttgtagttaacttcactgacatttgagattcccaccccttaagtcctttcattgcacacaagcagtcagctctctagctcaggagttcattatcattaattttattagaaggaagtcaagtttcatcattactcaatgagcaccactttttttttatactcctccctctctacttttctggaggttggctcttctatctttgcatacttttttgtactcttctttggaaaattttagtagcagcttgtggatatctaaaaatgcccatcttcataggaaaggacatgacctaatgcccaggcgtagacagattgacagaacgttgttaacgtgtgtgcgtgacgagacacgggtgtgtactgtaagtgacccattttattgattcactcagcaaatatttattatcactcctgtattcactgataaaatgactaaatcatctcaaaccatcattttcttctacatctaaccctatgcagcttttccctggagaatatgctcacagtttgtctttgtttttaacgtctagactgatgatgaatttacaaggtatataccattgtagaacacattccatactatttatttttatctatgttattatctacaaagatgcttttatagcattttgatagttctctcatattttttaacaatcaccactggaatttccctgcctaagaatgctggggtctgggcaaggataagacagatgtttccaccctgggctacttttcagtctcaagggttattatagacatctgtgtagcatgccttggttggagagtggaggcactgagagaatctgagagattaagatcactgtgtttgagcaatgaggcattctggagttatggtcaaatactgtcctactgagagaaattcacaagagccatccctgccaccttagtcaagcccagtctaccccatcagctagagtcagtgtattagtccgttctcacactgctaataaagacatacccaggccaggtgcagtggctgacacctgtaatcccagcactttgggaggctgaggcaggtggatcacgaggtcaagagattgagaccatcctggccaacgtggtagtagagaccccgtctctactaaaaatacaaaaattagctgagtgtggtggcacatgcctgtaatcccagctgcccgggagactgaggcagcagaatcgcttgaatccgggaggcggaggttgcagtgagtggagactgcaccactgcactccagcctggcagcagagtgagacggtcaaaaaaaaaaaaaaaaaaaaaaaagaaagaaagaaagaaaagaaaagaaagacatatccaagactaagtaatatataaaaaggagaggtttaattgactcacagttctgcatggctggggaggcctcacaatcatgggggaaggcaaaggaggagcaaagtcacagcttacatggcagcaggcaagatagtgtgtgcaggggatctcccctttatgaaaccatcagatctcatgagacttattcactatcaagatgacagcacaggaaagactcaccccacgattcaagtacctctcacttggccccgaccatgacacatgggaattatgggagctacaatcaagatgagatttgggtggggacatagagccaaaccatatcagtcgggaagagtgagattgtagtttctggacgttctgctaaactaattatcccagctactcctatgaaggtagtaggtcatgtgtggcattataggattattagggagagtggattctccagcaatgccaataaagatgccccagccatggcagtaccaatatcagaggcattcagggatatagaattactttgagacctcaagccacatggttcttcatttggatgctggcctctattagtgtattagagttccctggagtgtttgttaaaacacaagactgcggagcctcagcccaggagctccttggggtggggcctgagaattcaatttcctaacaagttcccaggtgatgttgatgctgctgaacccaggaccatactctgagaatcactggcctgtacttaccctgtcctctgtttctttggagatcttacaaatttccttgtgagttggggacataaccagaagaatatgccttttgtgggggaaaatgttttctctttaacttcagttatttcaaacataaaaaattataaactaaacactgctggccatccctcttttttaaaaacaaaacaaaacaaaaaaaacaggtgtctagctctgtcacccaggctggagtgcagtggcgtgatctcagctcattgcagcctctacttaccaggctcaagtgatcctcccacctcagcctcccaagtagctgggactataggtgtgtgccaccatgcctggctaattttttttattttttatttttgtagagatggggggccactatgttgcccaggctggtctccaactcttgggctcaagcaattcacctgcctgatcctcccaaaatgctgggaatactgtagtgagtcactgtgctgggccccaaccctcatatttaacaaatgttagcagtttgtcatatttccataataatagctattgtttatgtaagtgatttatgtggtataatttatttacctctcacataactgcatgagagaggtgctcttattatccccattttacaggctcagagatacttaaagtcacttgcccaaggcctggcagctagcaagcaggagcccagatgtgagcccaagaagtctggctttggggaatctgtgctcctcactaccaaagcacactgcctccagattttagttcattcttttcttctttataaaaggtaaaaacattcagattcagacaaagttttatctgtatcctacccatgaccccactttcacttatacaggtgccaattctcccgaagtcggttgaattttgaggggaaggttttggggatcatctttgggttctttaatactagaagttaccattttctgtatgagcttggccattttggctatggagaaaggcaaaaaggacttcagtgggaagattgatgccttcaacagctccctccttgtaaccgcccagtgggttctctttacccgcttcctagacagagccaatttatcaagacaaggggattgcagtggagaaagggtaactcatgtacagccggctgtgcatgagatcaggtttcattattactcaaattagactccctgagcatttggggatcagaatttttaacgatcatttggtgggtagggtcttgggaagtggggagtgctgattggtcaggttggagatggcatcataggggatcgaagtgagtttttcttgctgtctactgttcctgcctgggatggcagaacagttgagccatactactacgggtctggctggtgtcagctgatccatccagtgcagggtctgcaaaatatctcaagcactgatctcagattttacaagagtgatgttatccccaggagcaatttggggaggttcagactcttggagccagaggctgaatgacccctaaactgaaatttctaatcttgtagctaatttgttagtcctgcaaaggcacactggtccccaggcaagaaggggttcttttcaggaaagggctgttatcaattttgtttcagagtcaaaccatgaactgaattgtcccccaaagttagtttggcctacacccaggaatgaacaaggacagcttaaaggttagaagcaagatggagtcgattaggtctaatctctttcactgtcataatttcctcagttataatttttgcaaagatggtttcattcacacccagagacaaagctgagtgtcctacagaatgtggcagccccgctctgccagtctctgttccagggcttcaggcggtctctccaagctctgatttattcctcctcactggctggctccacttaactctcaggctactgaccttggcctcaacactggcatctcccttgatctctggatacctcacttattcatttactaacaaacatttattgagcatctactatatgtcaggtgctctcttaggccctgacaatgtagcagtgagtgaatcagaaacaaaaatccctaccctcagggtacttgcactccagcttccttctagttctctctcccttgctgtttctcagacttttctaagctccatgttctgcagtctaatgagtaggctgctgtcctcttaagcccagccctggttcttttatcctggcctccacttctccagaaagagccagagtataaacacttatctaagcatgaaggcaggcatgagcctcagactttataaaaagctgagggttttcgcaacattggtgtgaaaggaaaatatcctgggtcctttcaagttgggaactgctcagggcaaatcagactcccatcctattcaaagtcatccctctgctcacagagatagatgcatattctgactgcttcctttggaaagacttatcagaaactcagtgcaaccatttgtctctcacctacctgtgacctggaaggcctcagcggggggccttgctttgagttgtctctgcctttctggactgaactaatgtacttcttacatatattgattgatgtctcatgtctccctaaaatgtataaaaccaagctgtgcccgaccaccttgggcatgtcctcaggacttcttgaggctgtgtcacaggcgcgtccttaaccttggcaaaataaactttctaaattaactgaggcctgtctcagattttctgggttcacactgggtagaagcagaatcacaggtggaagtccgaaagataggagaggagctgcccaggcacaggcggggcaggagagtgaggagccccttgctctcttttggctcatcatggtctgtggtacttcccaagactcctgcacagcatccccagatgtcacatggttttgcaactgtcactgcgcatggcgcatgctactgagatgggcactttgggttggagctctgcctattgaagtgccaaagcactggggactgggaaaaactgcttgctaattgcccctcagtcccaggtctcagttctcatgcttctgagggctgaggtagagcctgcatttagttatttgttttttcctccgtttgcccgacttctgggctgctcattttgtcacggtgttcttttgttgttatatttgtcaggacttattttctttgaaggaaaagggcttcaacccacatattatgagaaattggctctgacatgtatttctatttcttttccaaagaaatttccctatacattttctcaaagtgtcattaaactctaataggcttcccccaatacccccgcccccgaaccaagcctgatttaaccgagcattttctgaaacaaggtgactcttatttaaggattctaaatgtattccagttcttggcagtcttaagcacacagctgaatgcatgttaagtctagcatggataattacaccagctgtgaccttttagaaacatgtatttggactaaagtggtgtttagtcacttttgattgacttaggttttacttggtttatgtttggtaaacttcaaatatttgcttccgtataagctggttaaactcccaaagagcactgtgtgtggtctgctgcgttgaaggccccctctgtgatgtcagtgacacaatgacactacatgtgcttgtatgcatgtgcgtgcacacacacacacacacacacacgtgcatacacaattagaggcaggcggagtggctgatgacatttggaagtaatgtagcatgacactgccactcatgggtgtgaagtccaaaagggcactgactgtcaggagacaaacaggagctgtgattgctttaagatcattcccatgcagttgtcgaagcggcgggagagagcacttgggaaagagctgctcacccattattctcagcagcctaaggtgaccttggacagcctcttaacctctgagcagtgagcgtgtgggcatggcctgtcttccagggccttgcagttccgtgcagccttggtgataaaacaacccctcagatgtggtgcaaacacaaagacaaggggacaagtgcccctcctcctccccttccccttctgtttctccttctcctttccctcttctccctcacttcccctacccctgcttctctccttctgtttctccttctcctctcccccgcctcctggatttcccctttttgtgtggttctcaagcattggaaattccaaagtagccagaaaaggggccactagactgcctttttctgctagctctgtgagcctaaccccgtttcaacaaagcctccatagctcttatttctgaataactgaaagattgagaagcttattctagatgaggttgaaggcagccatgcaacaaagtacatctggacagtcccacttaagagccatttctcgccatgcaggaactgacctgctgtggtctcagcactaacagaagcctggggttgcaaagcggaccatgcagctgaaggtctctgagccattgacctcagctttgtcacatggcttgagttaaggtgaagaaggtctgctctctggggttcggctatcagccttaatgacaatctttaagtcagcaattcctggtagcaagagtcacccaggcaaaccttcctggcatccaacatcagcctccgcttgcctctgcttgaccttgattccagctctggtgttttatgctggccctgcttaggttttcgttttgtaacttgtttggcctatatttaccctatgttctatgtttctttggaggtatgaaaaataatcacataccatacaatttaagcatttaaagagcataactcaatagtttgtttagtgtgtactcggaattgtgtaacaatccctacgaccaatttagaatcttttcataaccctcaagagaaatctcttaccgttaactaccaccccataataccctcatccttttcccccagccctggggaataactaatctgctttctgtctcgatagatttgccttttctggatatgtcatataaataggatcatataatatgtggccttttgcgactggcttctttcacttagtgtaatgcttttctggttcatccatgtcgtagcatgtaccagtactttattcttttttgcagctgaataatattccattttctaaatacatcagattgtttttttttaaaaaaaaatccattattttagggtcaggggtacacgtacaagtttgttatataggtaaactcgtgtcagtggggtttgttgtaaagattattttgtcattcaggtactaagcccagtacccaacagttattttttctgatcctctcccttttcccaccctcaagtaggtctcagtgcctgttggtcccttctttgtacctatgcgttctcatcatagttcccatgtataagtgacaacacgcaggatataccagattttatttatctattcatttgttgatggacaattaggttgttgttacttttcaactattataaacggtgctgctatgaacatttgtgtatatatttttgtgtggctgtgttttcatttctcttgggtacagacctaatagtgcagttgctgggccatagggtaactctatgtttaactttttgaggagctgccacagtattttctaaagtggctgaaccgtttgacaatcccatcagcaatgtgaggggtccattttttccacatccttgctaatacttctcattgtctgtcttaatcacagccatcttagtggccgtggagtggtgtctcattgggacatgattggaatttgagcatcccttgaaatttgaattttcatgtggacagcgcccaggcctcctttgtctggcaccccatctctctacatcttgcccagtgcccagctcatagtagtaaatgctcaagtcctgtgtggattagatgaaggatgtggttttccatatttgctgttcccagtgacactctatctgggctcctgcctcagaagtaggattttttgctttctatccctgatctccttttaccatctgaatacccaccctaacttttggcttcacatttctgcgtaaagatgaccattccttccttgaagtccaagtgagctcagttatttaggagagagtatgcttcaaatgtccctaatgctccacaaaagcccagtaaagctctcacatgagttcttctagctcagtgcctggcccacagatgttgccaagaaatgctgccttccttcttctctattgcttgtgtattgtttcctgtagctgcagtaacattaccacaggctgttggtggcttaaaacagcctaaatgtattaccttacaggtatctaggtcagaaatccaaaatgagtctcactggactaaaatcaagatgttggcagggctttgttccttctggaggctctaggagagagtctgtttcctttccttcttccccttcaagaagctactgagattccttggcttgtggccccttcctccatcttgaaagccagcagcattatgtctcatagatcctgcttttgtagtcacatctcctctgatgctctttctcttccacttttaaggacccttgtgattacattaggttcacccagacaacccaagataatctcttagtttaagatctgctgattagcaaccttaattccatttgcagccttaattctcctctgccatataacatcatatattcacaggttcttaggattcatatgtgaacatctttaggaggtattttctgtatggcacctaactttccttttttcttcctcactctccttccttccctccctttcttccttcccacctgcaccactacattttaataggggaagaaactgaacagactgtcactttaccaagcatgcaggcaggtcagtggcagttccagggtaattactgaaatgccaaaggcagtagaagctgtctgtcaaaatcggccttgtaacttgtaggtctttcagggtatatattttaatgggactttaacttcacaaggtttatttctttgagaatattatgaatttgcaaattatagaatgcaattccttcatcctttaatcagaaccattcaaaaggcatgttattcaggcatcatacacaaagaggataaattactgggtggcagaattgcatcctggaattgggaagaaagcagagggaagagcccgaggcagagagtcctttagtactgtgaacttcactccagcccctgagtggaggctgacgggatcctcagggaaagggcttaggactgggataaacctggagaaacaaaatctggaaggtgaatgggagaagggaatgggaagataatggagtcacaaagcaatctaaactttttaaaatttttccataaacacatttgaatgatgacagatgaaagtaattttattcattcaactactctttacttgggatgtgcagtttgcatatgtgatgggtgtggggcaagaagattgtgaaggcaaaaaacacaagacaatacccttattttaaatgagtgaatactaacatgatcgcaccctcgtgcgccacagtgcctgcaagggcatgatgatgtcatgcgtcgtgtgtgcttctactttcctggccatccagtacccaattcctcctccaggttttgagtattggtggcacttggtaccctgccttctaatatagaagctacagtagggagattctctggaagcagagtgccctaggcttggtcattcaggattgaatggggcctgcaaaaagcgacagtgaggattcattgatgccagctgcagcagaacctggtagcaaagtagtgacatcttggtcgggcctgtgtgtcagaagatgctgcctcttggtcctctgagactctcttcgttcttgaccattttctaagttgggttctccatcttctcatccatcttgtgaaccccaattcctcctttaaatgatgtctctgcttaacatagcaaaatctgttttctgttgcttgcaacttagaacgctggcaggtatcactgtttattaatcaggagaaaacaaacttagtggtagctgataatgcagccactatcctggaactccaggcattagggcttagggaccagcatttccctctgccaggaaggggcttcttatctccctttctttcttccctaacacttctccagttcactgatagaacatccagcacattaacccataattttagtaaatattaaatatatcaagggcctgttttgggtcaggtgactgctgcaggtaaaacagtgtgcatacctttgttttggtccccaccacccccttacctcccatcggctgctgacaccttagtcatagacccctgccagcctctgcatcctcagcagcctcagcttccctttcacatcagaaaactcagctgggggcctgaaaaagaataaccacaagcctcaggtagacccaggctggtttccttcccaacgccaccctcagattcattattaaatgatgctgtggactccagggagcccatgtctctaaacgccacctgatttcctcagaaatgcacctggccacctaggagtaggtaggtggaactagaaatcagaaaatgattgtttccctagtctgaagaaagcaccccacagtgtgattttctcaagagaaagtgcttgctatgtgccctgagtgttttaaggcaggctggctgtttttggaagccacccactttccttcatttttgtcttcactaccctaatctgaacaaccaccctcttgcatgacattctgcaattatccctacctgaaagccccctctccacatcccatcaacagccagaatgtttccaaagtggaaaccagctatgaggaatccctgtccccactctggtaaatgttccccatgactcctagatggagctacaaggagcatcagtacctttcacctgcagggcatgagggtcaggtacttacccactagtctggtctgagtcctacttttctctgctcttgggaagtgcttccttctccctcctccctccttctcctcctctgcagttatatctctggtcagttcccaaatctctttacaacaggctctcatcccacttaccctagtgttgattttatttgtgtggatgtggttcttccattaacttgcatctcccctgtgagccgcatgaggacagggaggttctgtctcatttttctgcccttctaacagaaaattcgaactatgggcctacatttacccttcctcctactctaataactgagccatgaattttctcagagcagcaacatgctcagctttctgagagaccacatttcttagcgtcttttgcagctaaatgggaccaggtgaggaagttcaggatgtaaattacagcctggagcacatggcaagtccacctgacgggaaatgactccagtggaagaaggcccttttgtctttttcactgcttgggctgtcgacatgatggctaaaacttgagcacccatcattatgatataggagttaagaagaaattacttaggcagatagtgggggtatgagaatcctcagtaaggttttccttttaaggaaaagcagccccaactcattttcatttctagcaaagagcagcctgtagaatagagctgcagacatagatgccagcaattgtgccagtcatgttcaaaatggcagcaccatcttcccttctctttctcatccacgtgtacagtaaggaacagacaagatggcactggtcaacgggagagttcatttgcataataagtttagggtggggcagccagccttcctcaagtgctatgtaaatgtcatacctgatcgaaccaacctgtgaaccctatgtaaatcagacattgcctcctcaaacctgactgtaaaatctggcgcatccgccacccaccagtcctttctgcttggagactcctctctctccatagagagaactgtttctctttctcttctcttctgcctattaaacctccactcctaaactcctcatgtgtgtctgtgtcctaagtttttccggtgtgaggcaacgaaccccagggtatatacctcagacaatgtagccactttaattaaaccatgaagtgaagctgtaggttgatggagcatcaagatacaaggaagctgagtccctgatgaccatggagttccccatcaaatctggacggcttgacttgaggctttttaaaaaatcattttcattgtttcttcaccatacaaaatgtattcaaatcacatccatttgaagtggtaagatcatagctagagaaaaagttaccttgtaagaaatttatttataaaacacttcatgagagttttttcttttatatttcattatcttccctgattaaaggagcatacaacacaaagctaaacttattagtattttgcctactcttagtttagagagaaataattttcttatttaaaattatgcacccaataggggaaaaaaaatctcataacgtgacaattgtcctctgaattcctctctgtatgagtctgtttttatacggctataaagaattgcccaaggctgggtaatttaaaaaggaaagaggtttaattgactcacagttcagcatggctagagaggcctcaggaaacttacaatcatggcagaaggcaatggggaagcaagcacctttttcacaaggtggcaggagggtgaagcgccgagcaaagggggaagagccccttataaaatcatcagatctcatgagaactcactcactatcttaagtcaattaaactactgtgagaacagcatgggggtaaccaccctcatgacccaatcacctcccacccagtctttcctttgcatgtggggattatgggaattacaattctaggtgagattcaggtgcagacacaaaacctagccatatcactctttaagcatctttcttcaaatttctcctcttatacgtgccagttgtcatgtacaaacttagttcgtacttccttttcccagaaaggcaaggttttaaatactccagcttcatgtacagatctactttatgtacattcatacttaaaatagaagtaaaaaaagagaactgcaaccaatcataaaaacaaaatacaatctcaaaaaaaaaaaaaaaaaatacaaacccactagaaaatagcctggcagtgtttaaacactaattgctatttttgtagaaaattgttagataataaaatgtgagtagactacataccaatgtaaataaatccattgctctgcacagctggtaggagtaaacacacatctcacactgtttgacagctcacgtgttataatttacatggtttatactctcagggtcattctatcataattcccaactactaacttttagccatttcatatgtgatctgtaagagcaacaactccacagtatggacacttactgcacatttagtacttaaagtaatacaaatactgtagtactacccactttgcatgccagacgatatgataaaaataaaatgacaaatgcaagcagaatctggaatggagcatctaactaatgggcatttgttaagcatatttgctgggaatatcttttgcataaaggaacttttgagacttactaggcttcctctgattttcaaaacaatacattgggaatttcattaccaaaagatttaatgagacattaaataaaacacacaacagctgatccaggtgaactcattcattaaactttggaaaaagtctgttttgtgcagctggcaaagagaatgacacaaagctggaagaagaaacagctaaccagatgaggtcaatatggaaaatgaggaaaagctgggcataaaatgtttccaatacagggaagaaaaccccacagtgcattttcagggggcacttaatacaaaagtctccctcccttcccactctggtgtttcatctcagaccaccccaatattttgtacaagtctagtgtgtgtgagcggaggtaggtgaggatggaggctgaagcaaaaggaagataatcctatgtttgggttttttcccaaacatctgcccaggcatacctgcccaaattgtttaaagtgctggtactattgttttgatcccaccagcccttggcctgttgtgtgaatctatctgtagcaaactgctggggctgcttctcttttgttgttgctgttgttgttttcccttaatagatattttcaattccattaaccacacattaatctggtgtctactatgtgcctagcatggtttctgacacaaaatatttcagtctaacaattccttttgtgttttctttttatgaaattcctcctaccattcccacagggaatggatcatctggggaatggatcttgaggtgctacagagcaaaactagacagatttccagtgacagacatccattatcacctcccagtgggaaggttattcttgggatgttacttgtaggattttcagctgacatgaaacctcccagttgggagactttcctgaacagtaaatcaggggacaccctggcatgacattaattcattttctaggctctgacttcccttggttccacatactccacagatgaagaagaaactgtcctggccaggactattgcagctatcaagacagttgtagcccctcttcctactagcttaagtgaatgctattacagtctcatggacttgggacacgtttatccttagaagattctcatttgcccccatcctgagactttccccagagtacagtatagaaggatcctttctgctgtcataggggcctgagaagttcaaggataaagggatccctacctgctgctccgtggtactgctctctcatctgacatcattctcttttcaaatgggtccttctaatgagggaactctagaactcccctccagagaaaggagcgagatgggacaaaacttctctcaaaggctgctaaaacctagatcactgaggcttcactctgtgcctagcacgggggcagaggtgggaagagtaagcagggcgtggaccccatggagctcagggttaaagggaatttagatggaaaaaaagagagactgatgttggaggggggggccgtgggatacctgggggaaccagaggtttattttagatagtctggtggggagaagttctctcacctcaccctggactcagcttgactaatttgaactagcaaaaactgttgaaataaacaaattaatggtaatgggtaccatataaatgcttaaacgctggcttttaaaaaaaggaagaaagaaaggaaaagtaacgtttaaaccatctacaaagagctcctaagtaggcatttgctacaaaaacaatttaaacctagcaatacattggaagcagggagtgggtggtttatggagacacaaaaatccacaacagcttaaagtgagaatactccattatatttcttctgtatttgcaacaaatatttgaaaataatttcctcaaatagaaatctctggagattctcttgacctagtgtgagacaatacatagcttaaactgaagcatatatgtaacttaaatataaataaaaataattagattaggtataaattaaatcttcatttttttatagtttccaaatttgcaaatttgtctccttgctataatttgtttgtaatctcaaaagcaatacttgtggcttttcatggccattggtggacatgcacaaggccgtgacaaatttgagtactctgacacacatgttcccagctgaggttgcacagggccatgttctgccttcttgtttcagctctcaaacttgcaaacaagtttcttttttgccatctatttcctcccgtgtttttcatatttttgtgtttttagttggtgatttaaaattaaacccacgtgtagcactaaagcactatgtagtgttcctaagcacagaaggctgtgatgtgccctgtggagaaaatacatgtgagataagcttccttcagccatgagttagagcactgtaggctgtgagttcaatgttaatgagtccaaaacatatactaaataaggtatctctgaacaacagcagacacaaaacaaggctataaattggtgggttgacaaaagtgctgcgagcagaggtttgcaggaaaccctctattttttccaagagcaatggctcagtattccctaattcaattcagcgttgttgtgatgccatagatcatagctacagcaggtagcgagaaccaactgtgttcctagggagaactagagaaaaggatttcatgcttttgcaggagtccaaattggtctttcctgtagttctatctcatattaacagaccccaaagatgggtttctctggagcagatgtggctggaactgtcattaggaagtttagccctattgtacagcccatccctcagacacagcaagcccccccaggatggaggtaaagcacacgtgtgagatgcctgattgctcatctttgacttgctgagtcatccatgagatctttgagcgtgggacaaagtaaggctttcccaagggagcctgcaactgtgcatttagacagtgtttggtttgtttgttttgtctttatgaagaaaaccattcattaaaatgtccgagttgttctcaagtttgtagtttacttcatgataatatcttggaggaagaagggacaacattgccttacagatgttctggctccatgatttacaaaataccagtttatgaggagaattcacacaaagcctaatcaactgcacatggcttccaccaatgagagcatgtctagaaaataagcatcaaatctcaggaacatggggctctttatgctccatgaaccatccaaaggatctaaatgagaacagagctggagcagagaacaaagctttaatctggagatggcaaacacctcccatcttgtgggccaactgggattgattggtacttattacagggaaagggtgttgagaaggagtctgatgccaaatccacgttcactggtggcgtgccatgccgcatgccatgattgattagtgctgtcggctgagggtgaggagcagggagcatatagactgtgcattcaccttccacaaagttaaagcagtcaagtttcagcagaagaatccctctctccctatacctaataagatcatgtctgatttggtgatctctctcaaagccatgctgaacacattgccgcatatggagtaacagctcaataaatcattgcccaatatagatatgtagatatgcatcagggaatatgtaaggggaatgaggggaagaaggcaagtctttcagtcctctgaagtagggttggaagaatagtttgaggccacaaagtcttccaatttggcttgaagtccaactccataggtagcagcctcccttgccttcacctaaagccaattaaagatgcaaaatgttgcagctgtcaccagcaccactcttgaggaacaaggtgagctgttagaagccagagactcagcaagatccaagcttgagaatgaattttatgatatttttgagttttaaatactatagctacacatggggcactacatagaaagagtcaccaaataaaaggcttctctaagtgatctgtgtccatttcaggatcttatgaatcaacagaactgactggtctccttgggactgtgttaaacctgaataggatcaggtcatccatccctccttaggtcccctgcagggctgaaggtcacaccagggcttctttccatgatctgctcaggagccacacagaagggatacatgcctaaacagcatggagacaggacccccaggggtgttggggaacacagcagaactcaaggacttatagcaggagggaaaccctctctctctgccctttgaatggagtccaagcagtgttttccagtgtggtgcacagatgattcttagaattttgttttaaattacttaaaataatttcatccttttaaaatgttttgcatgtttttaatatgcaaggcatattaccatagtggtagaataaagaagtgaggagccctacccccaccagccagtgtgatatcaatggaggccttagtgggggatgtgaagttccaccctccagttgtaatgaggttctcctgccctctcaaatgaaggcagagtggggaactcggactttcacccccatttggcagtaatgagttggggtggtgtcagaatgttgtggtgcctgctaaaacagaagatttaaataagaaccagagtctcatgatataatagaaacattttcaagatacaattgaaaatcacccatcatatcaggaactaggaacatcctgacttgaatgagaaaagaaaattgacagatgccaacacctgcgtgacacatacgttgggattatgtgacaagaatcttaaagcagccactatgaaaatgcttcagtggacaattatgaacatttttgaaacaaatgaaagaatagaaactacagcaaaaaaaaaattaaatgtctcaggggaaagaaaacagaagttacaaagaagaaccaaatggaatattcagaagtaaatttccagtttatacaaaacctgaaattaaaagaaaatctcagtgggtgagctcaacagcagaatggagggaatggagggaagaattagtgaagtgaaagatggaacaataaaaattagttaattggaaaggagtgaaaatagactgaagcaaaatgaatgcagtcccagagacttgtgggattacaactaagagcatgttgaagtcacagcaggactagaggaaaagagtggcactggaaaaatatttgaagaaataaaagctgaaaatttctcaaatcttgcagaagacataaacatcagattccagaaatgagcaaaccccaagaaatagaatcccaaggaaatccatgccaagacacatcatagccaaacttctgaaaacggagtcaaagaagacttcttgaacagagccagggagaaatcatatcttacctgcaggggaaaaacaatttggatgacagcagatttcttttcaggaaccatggaggccaaaaagaaatgcacagtatttttcaaatggttaaagaagagatctgtcaatccagaaattatgtcccgtgcaaatatccttcaggactgaaggagaaatcaagacattctaacagactttgtcactagcacacctaccctaaaagaatggttgaaagaaattccccaaacagaaaagaaatgataaaagaaggaatcatggaacttcagttaggaagaaagaaaacttaaagagtagaaatgtgagtaagtacagtggactttccttttcctgttgattttttttcttttctttttcttttttttttttttttttttttgagactgactctcgctcttgttgtcctggcaagagtggagtggcatgatctcagctcactgcaacctccacctcctgggttcaagcgattctcgtacctcagcctcccaagtagctgagattacagacacccgccaccacgcccagctaatttttgtatttttagtagaaatggagtttcaccatgttggccaggctggtcttgaactcctgacctcaagtgatccgccaggcttggcttctcaaaatgctgggattacaggcttgagccactgcacctggctcccgttcagttttctagattacatctgatagctgaagcaaaaattataacactgcctgttgtgcttttcaatgtatatagaagtaatatgtaatgttatatgtgtgcgagggtaaagggacttaaagggaggtaaggttttcacatgtcacttgaactggtgcatgcaatactaggagactgtgataaattatgtgtgtacagttgttcctcagtatctgtggggggcttggttccaggaccccctgtggataccagaaatcttgatgctgaagtccctgctataaaataatgtggtattggcatataacttatgctcctcctctgctatgtttttaaattgcctctagattacttataatacctaataaaatgtaaatgctatgtaaatagttgttacactgtattatttagggaatcatgataaaaaaaagtctgtacgtgttcattacaagcataatatttttttccaaatactttttatccagtttggttgaatccacagattcaaatccatggatatgaaaggcctactgtatagtggcctttagtggttagagcaaccactaaaaaacctatacaaaacgatcacggaaaaacactacaggtaaatcaaagtggatttaaaaatgttcaggtaacccacatgaaggaaagagaaaatagaaatgaaaaatattaacttctttttttttttcaaaaacaaaacaaacaaaaaagccagcaatttttttatttttacatgttatttatttattttttaattgacaggtagtaattttgtgtattcatggggtacatagtgatgttttaatacgtatactgtatagtgatcagatcagagtaattatcatatccaatcaaacgtttattatttgtgtaatttaaatggcctaaatgtaccagttaaaatacagaggttgacagcaggcagaaaacataatacaactacatgctgtaggtaagaacttatttccaatggagtagtataagtaaattgaaagtgaaaggatggcaaatgatacatcattaatcaaaagaaagtggagcaggagtggctatattaaaatcagataaaatagacttcaaaacaaagaaaattaccagggacagagagaaatattacataataataaaagggccagttcaccaagaagataagacaaccctaaatgtgtacgtacctcacaaccgagctgcaaaagattcaaaacaaaaactgatagagctgagcagggaaacagacaaacccatgattgtacctggagacttcaaaatccctttctttaacattgatagaacaattaaaaaatcagcaagaatatagaagaatcatcaatcaacagggtccaaatggcttttatggaacactccacccaacaacagcagaatccacattcttttaaagtacccaagtaacacttaccaagagagttcataacctgggccataaaaaaagacctcaacatatttataagggctgaactcatacagatgacatcctctgactctatggaatcaaaccagaaatcaatgtagaaagataataggaaaatctccaaacacataaaaattaacaacagttttaagtaactaagggtcaaagagaagtctcaagggaaataaaaaatgaatgaaaataagtaaataaaagggcaggcaaatgtcatgtataattacagtgtaaaacttagtcaaaagaccatggacactatctctaaatgtaaagtgtttccttcccggaagagaacaaaacaaaacaaaacaaaacaaaacaaaagaacctgggaaggaggggatggagaaaatactgtgtaccaaattccagttcatattcttctttccggggcacacggaataccataattcccagctccttttcaagagttgtgagtaaaaaaaaaatgatatattcaaattagtattatccaaagaagtttagttaaagggtgtagggagatcacaacggatattacaaaataacagggttgttactaatccgaggcttgaaggggcaagtgaaagacttggttaaagactgtggagaggtggggaatgtgtagagagaaccacctggagaggagctgtgaccttcagtccagtgtcccagctttggcaaggtgacccaacagcggggagcctggagaaatccaccttcctctccttcctcctcccctgatctcctgcctgaatcccagtgcccaaactcaatggaagccagaacgttgactgtatggcaaagtgtccctttgctctgtaatccatacagatcagcctagcagagcagaaggcaaggtggggaaaggttgatcagaaattagcgggtagggaagggggatgtggaaataaatggaaagctatttgagtagcagagagacccagcgactgggtgacaatctcagagacatgtttaaaatggcaacatcactagatgggctacttggagaagagttgccaaaagatgctgcccaagctcccattgaccacgatgtgagtgagaaataaaccttcattatattaagactctgagaactggggttgtttgttaaagcagctagtggtaattacccttaccaatacactcaataaagtcagggtctcaaattctattaatatgtgaagtggaatattaaatgcacagtccagtactccggagtaattaaaaagtgattccaatatttacttgtgtctcctgaaaaatgccaatggggatatgactcataattttagtgactcctctcaaaagctgtttatcaccaatgcaatcctgttttgcccagatactggcatccatcaagcttcgaaaactccccccaactttcagtctgtacaggactttttcatctcctctttcctttcagccctttataagtgggttgtttagcctctctttttgttttccccatcctccctttagtcttttttttttttttttaatcacagaagatccccgaatctggccaaatacagagggatgtgtagggcttataattaagagacgaaaacgggagggacccagggatagggctaaaacacaggacatgtgcctgtcgcaggccgtcctccttgggaagcagtctgagacagagttgacacgtagcatgctgattggcaaggatgttttggatggacactcatggaagggagagggaggaagaaggatgggcagagggcaagcccagctgtgatgcaggagctctggagcccgtatgtcccatcagtcttgtctttctttgggacaaaatggcttggcctttatccctctgcctccatctgttgttgatgggggtcgcccagggaagcaggtgacctcgagtgaggagaatcctgaaagggctgacagctgaggactgagggctgacagctttcatcgcagttgggacaacaaatcctgccttgcagagagacctgggcaactggtctctgcccatcaccatgcagagggactgcgagtgtgctcgggtgggctgcagctctggttctgagctgtctgcagtttgtgtggtcagcgttgctgtgaagattgctgttgcttcgtccacgttcttcattctttctgtgcaatgctttgaggcccttatactgtgccacatttgccactcccttgaagaaccccatcagtatttttactttcaacaggcctggctgtctgaccctcagcctctctttccctcctacttcaacactgccgggtcctttccttgggaactgcatgcagcccctgaagtttctccctaggctctctgggccgcagggttatagagaagtgtgctgctggccttgctgtaattcattgatttcttatttttactgaagggcaggataatgactgtagtcactgcaaggacttatttatggctctgtccctcctgattgttagccttaggaggcactctggggctgtggataactcgccggcctcctgattgtatgtaattagggcctgggtaggaatagccttttaatttctcttttcccaatgagcctgatttttcaattcttgcagtgacccagaccagccttgtgtaaactccactggagtcaagcccttatgagccccgagaacaggggaataaaggcggtggagccctgaagcctgcctctgcttgggtttgaaacacagatcaaccatcactatgtataggggctggggaaattttattaatccatatacacttcagtttcctcacttattagacatggataataacgcctcccagttatagctgctgtggggaaaaatttccttaccatgtgcttagctctgtacctgacaattaataggcatccaagctgtgtctatcgtgtcattgtcattattgctatttccactatttttttccttcagcttttaagttcaggggtacacgtgcaggatatttccacttttcctgagagaaaagtgaagctcagactgcagtgattctgactgcttttagcagcttctgagaatgtatttcttttttttttttttttttttttttttgagataaagtctacctctgtcgccgagggtggagtgcagtggtgtgatctcggctcgcagcaacctctgcagcccgggttcaattgattctcctgccttagcctcctgagtagctgggattacaggcgtgtgtgaccacgaccagctgatttttttttttttttttgtatctttagtacagacagggtttcaccatcttggccaggctggtcttgaactcctgacctcgtgatccacctgcctcggcctcccagatccaccagctgggattacgggagtgagtcactgcacccggccgagaatgtattttttcaccaactttgtttttggtactgttttccccaacctgcctctagttgtaatgccctagtaaaatcctacaaccattctaatgccaacttcaattgcagtgcccccagagagctccttttgaacccttggttcagttttgttctcactggtcgtgaccagtgctcattggctatggccctcctggttacggagctccctgactctaccgaatacctaatctccgaggggaacaaagtaggctaaggcaagaagtgtgaaactattcaagggagtagtttctggatagttgtcaatatttaatggccctctccacatctttagcctcagttcttgtgatggttaatactgtcaacttgattggatggaaggttgcagagtatcgatcctagatgtgtctgtgaaagtgttcccaaaagagattaacatttgagtcagtggactgggaaaggcagacctatcctttatctgggtgggccccatgtaatcagctgccagcatggccagaataaaaagcaggcagaagggtgtgaagagactagactggcttagcctgccagcctacatctttctcccatgctgaatgcttcctgaccttgaatgttggactccaagttcttcagctttgggactcagattggcttccttgcaaaatgcagtcagtctcatatgatcaagattccatagaaaaacaaaacagcttttctgatggcgagagtggggaaggagttcttggtagagaatgtggcactttagtttgacctggaagaatgggtgaaatttcaactggtagcagtggagacaggtccttccaggctaaggaaggagcaggaacaatggcaacaggagtgattgtaaggtgtaatgtcgggacatttcatgcatccacgtgcagcttgaaatagtgggaagtgaggctgcatagctagttatcacaacgaaggccaaagctagataaaaagtgtgaactacttttggtagaagatctgaaactatgagacattctgagtgtctgagtgacatcagcagagctgtgcttttggcagatttatttggtaatgttgtgcagaagtttttttccaggtagagaccaaaagtagattaaagactctcgagagtaaggtgagatatctggctggcccagcccattggaaatgggactgcacacgggaagagtgtgagggtatttaagaagctggatgtgtacaacttggatggtcaggtagagagaggttttgaatccaagtaaatggtgaagcctttactgaacagaaaaattatggaggaagacaatgagttttactttagcaaaagaaattaaaagcaagagcacctggaaggaggagtggacagcagtaggaatgcagagctggagcacaacggttcatcagggttggtgccagaggttggattaattgcctttggagcttgtagggaagaatagcagaaagatggaaagctggtggttctgttgtttagtgtatagacttcttttatcttatgagggccccattagctgacagctttcctggcctgaagacaaagtgaaaccaattaccttgattgactgaggcacccaaaaacatttagagaggactagcttccttccacccccaaggctagaatgtggatgcagggtatttgctttactaatcatggttacttctttccatcacccaggtagggtgtccaggagacagcgttcttcctgcccttgctcctgtcagatagacaatgaaggaccagagtgttgtttcaaagtacatttctttctggagtcccagaaggaaacaaacactccctagttgtgtgacaacccagaaggcaggaacgttagtcgagggtgagaccaagtcctgaggcacacaggagccatagatcacctcatcttctcgggagactagctgagaccattgtcccagagtccttgggagtttacagttttgtattaaatttaagcatttccttttgatgaagtattttatgatgggcattgtaaattactctaaggaaactttttagtcaccaagaattaatggcaatgataaatttgggcaacatcatttttagtgtctctgtgaatgaacactttcaaaatttccccaggttctagtcaaaggtagagactcctggtgattatttttatatttccatgtctcaaagtggcttcttttattaagattcccaagaataagacttatgatttatcttcatgacatattaacagccagtcataccaaatacatttttctttcttatgtacccgaaagtatattcttgctgtcagcctttggggtaccatgaatttcaaaaagttctctggcgtttttgctaaacatggaacattttttagctttgtgagttatcaaaatagttagaggttctggagagaaaaagaaacagaaatgaagtcagaatggtgtcttatcagtaagaaataagaaaatgtgcaattcatcctgtgaccttcatttataaaatgactgaaatggactaatgtttatggggaatcctgtgaatgagctaacacaatttgtagttgaccaaaattggactcagtggccatacctgctatttcgaatataaaagagagttcatgtttcacattaaaaattattttcaaggcagtgtcattttggaaagaaatgaaattatttgaatttcacagggtcctttagtgtttatctcttggacttcacttcttggatatgtttgcagcagaaaaagtaatcaaatcactagccacttcggattttcccaaaagtagatgagtcattcctaactcattggaggagggaagcatctttcatctttgcaaaaaaacccacctttcttattttatataacataatttgtctcatcttctgtatgtaagctctcatatttgaattcagaggtcctaatagcaagttaaaactatgcaacatgtcccttgggtatttcataggcatcatctccacacaactagttaagaatttttatgtctctctgtcacatttcattttgaccttcaatttttaatttgaattcttataaatagaagcaaaaatgcatgacaggaaagggagaaacagagaagcaaggggatttatgcatgtgggtagtcgcctcttggtgtttctgttctgaagaggagatttccctgtttttttttttttaaatgggaaaaagaggacagaatgtggagattcaagagtgtgcagtggagtttggatttactctcacgtgtcctgatgtgccgtcaccatgcttttgcgctccgtggaagaaattgcctggatttctgcacagaacagaagttctggcacaagttcttgacataaaattactgctctatcgatatttgttgaataaatcagctcatcaaaatgagttggagtttaaattgtaattgcatcctgaatagagtacataaataaataaatagataaatgaaaaaggctattcttcctggatgttgttgcggccaggacatggaaactgacttagctttgccaaggaacctggtggatgctattgcatctccaaagtcactagaattggctcgaggttctggaactcacttgaatgaaccagaacaggtttgaaagctatagagctcagtttttaaaaagcgtaccctgtttgttattcattgattgttcatttatttatccttcacttactagttctacacattcatgaattttggtactgagcaggtgcttctttgatgtgttgcttcagtaagttattctattttatgtacttttattataagtatactaaggatttcctggccagttattgcccatctggtaccttccaatgtctattctttcttcctcacaacctagaattcctcacccacttcagactggtggtgagcaagtgtgtatgtgtgtagagtgggctgggccctcagtaacaatgactggatgtggggcactgatatgagccagtaggtttggtgaaagcactgaaatacatccagggctagatggccttgggaaatgaaacagactgtggggccaaatcaaaccccaccttagggtctaaaatcagagcacaaaatagatatcacatggagtccaaatgacccttgacaatcctttgaactgttcacagagttctgaatatgtcacctcctctgagcacattgggaaactacatgacacttcccaatgagccgtccccaaccagtgttcctccagggtctctgtctcccccaagactccctgtcccccattcctgcaattttccaacccctcttccccattcctgcaaccctccaacccctcttctctccttcctctttggtcgggtgcatatatttgaatttgtgtaaattaactataacgttagaccttggaatctagacttataaagttcaaaagtactggggaaagtacaaggaacagttcataggccggacatggtggctcacgcctgtaatcccagcacttggggaggctgaggtgggcggatcacgaggtcaagagatcaagaccatcctggcaaacatggtgaaaccccatctctaataaaaatacaaaaattagctgggcatggtgctgcatgcctgtaatctcagctactcaggagactgaggcaggagaatggcttgaacccgggaggcggaggttgctctgagccgagatcgtgccacagcactccagcctggtgacagaacaaggctctgtctgagaaaacaaacaaacaaacaaacaaacaaacaaagaagagaagagaagaggagttcataagtaacaggccggcaaaacgggattaggaagatggatcacctgttggacttgaagtcctagagcatggagggaaggccggccaggcagagctctttctaacatttctgctcactggctcaggagtgtcctcatccacagttccaagttgattggacaacaagaatgaggagtaaaaagagaagggaggaaatataccagagcccatacacagtcatccataacccctctccctgtgtttattatcaatgtggaattgaacgttgtaggatttcttgacttacatttttataaaactgcgtattgcaagggtatactgtacttaacgtgtttgtttacaattctcaatgacacactgaaattgagtccccagtttgaacacaaaaaatattttcaaggctgggtgcggtggctcatgcctgtaatcccagcactttgggaggctggaatctgaggtccagagtttgagatgagcctggccaacatggcaaaacccaaactccactaaaaatacaaaaatcagtggggcatggtggcatgtgcctgtagtcccagctacttgggtggctgaggcaggagaatcacttgaacacaggaggtggaggttgcagtgagctgcgaatgtgccactacactctagcctgcgtgacagagaaagactttgtttctcaaaaaaaaaaaaaaaaaaaaaaaattcaagacataccacctaaaaatgcaaataatttgtgatatagatgttttgaaattaaattgcaatatgatttaataatagtgtaaagtattatagagaaaaataaaattctgtcatcctgatgtaacagttcttttttattattattctccttccctcttttcttccttccttctttcccttactttcccttcttccccttcccttccttttgttcccttccttcctttcttctcttccatatttatgctgtgtctactctctccagatgctgttctagggcctgaggatacagcatgacaaaacaaagatttctgcccttctggggattacagatattaagtaacaaacataaaaataagtaaatagtatgtgaagctttacattttattagacaaaagagtcacctaggggaatatggtgtgagagtgccagggggagggtggcaggtaatgttattaaggacagtggtcaggacaggtgacctagtagtcaaaacttcaaagaaatgagggaggttgctgcacggatgtatgaaaaaagagcagagagaactgaaaccacaaaagccttgaagaaggagcttttctggaaagttccaggaatagcaaagaggcccatgtagctggagcaaaatgagtgatgggataagggtataggagaagaaataagaaagatgagatggagccccatcatgtagaccttgagggtgttgcctgtgtgagtggagttaagctgagaagctgaaagaaggcgcatgtttaaggcatccttctggctgctgtatggagaaagggtggaggaagggtaaggagggcagcagagggagcagtagggagccactgcagaaatccaagcagtgggtaattatccaatggataagtcaatccattatccaaaagatggtggtggctgggccaaggcaaagcactggttcaaacatacctgttgtgcctggctctaaatgcaatgcccttgacttcatgacttcgtgactcagccagtgtgcataatactgaaaaacagtatataggtcagtaaccctagcaacttagctgtcagtcttctccttagcactcctttcaaagggcctgtaattttgggaaggggcatgtcttagagagttttgctaattcattgcctgagtgatgtctggcagagaatatccatgcatttatcaaagtcctgctaatgaacatattaatgaaacattaatattattgtttgctgcttcaagaatcacatgctacgtccatttaccttcatgaaatctggtaagctaaatgtatttgagattatgagattgttttatgcctaatttattttataaactacatatgtaaatcatatcactctcacatgcaatttcagttgagagggtaacaacgatgttgccataattgagacattctaacttggggggtgcccacagaactgctgagttgcatgccatttctattttttagttgtttttagttttaaaaataacttccagagtgtcatttttgtaattctaatttcaatttatagtctaaacattgcaatgagctttggggggtattgcagctttctttgggtctttgtctgctaatgtttctattactgcatctatagtgaaacaagaacatttttttaaaaacttctgacataagcatttttctaaatgtgctctattgtggggcaccaaacaccacagggaagcttagcactgttgttgttttgggtagtgatgttattatggtggtgggagctttacatcttttccacttttttccaaggcaagtggaataagatagggatctgtgtaccctgatcgtataattccagtattggagagaatcttaaagatgatctagcccaagccttgtattttacagatgggaaaactgaggctcagtctggtgaattaacttaatgaagaatcagtacttacaacgtgttttcctgatattattaaaacatcgacagtgtcacacccagctatagtctgggtctggcctcgaaagaggaatggcatttaggtcgacagggaattcttgtgaggttttattcctttccccttatctttgctgtagtaatctgtcaaaagaaccattattcaggtttgaaaggacaccttcagcttgtaaaaggcaaaagagaaggggtttaaggtaactattctttccttagagttaggttgccaaatgatgcagaaaccattcttccaaagctgaagtaagatgtcgtgtcttgctatgcattgtcattctttagagattgagcaaccctccctgctagggaaccacagacttacaattcatggctcgcagggaaagtcgtgccctctataatagacaataatgactgtaataaaataaggccacagctcagacagcagagaagcaacactgttggcaatgcgggtgtaagcatggcctaactgatgatcatgctatctgggtcctggatagggtgcaaattctggtgctgcttactctagctgatcttggacaagactttgggcctctgttttctcatttgtaaagtgggaatgatagtgcatacctcatcaggcaagaaggcagtcaagtgacagagtgggagagaagagttccatgtgatatctggcagcatgtggtgcctactcacagttcttccttggcctaatgtcccgaaacctctgataaacagtgcagcacggtcagctgagaaccctgctgggggcaatgagagtctggtcagtgaggagattgagaggtctgctctttcagtgactatttttgagaaatattgagttttatcagccacagatttgtcagtgtagctgtagtggcagtgaacatgggagttctggattaatgtaaatttagggtttcccaagacaaggctgtctcctgttgtacataactaccgtgttgattagagtattaggcattgtgcaatgtggcctgtgccttttctttcctttgtttcccctttgtttttgggctgagttggcagcttgtgagtacaagcctttgggtctctctgttattatggcctcttgctgatttctgcctctgagctctgggcatgatctggtagcagcatcttgaaggtgtgatgatctgtgtgtcttttcattcagggaagggggcattgcccccagtgagctactagtgtagcaggtgcttcagcatgctggaaggactgctgacaccagccgtggacgtcagcaggcttcgggaattgcctgggctgaagagcaccatgtcacccaggacagttcacatccaataactggttgatgcacgagctagaaaggcctggcctctcacactgtcttgggacaatgctgaagagccatcctgggttcacagctccctgtggggtccactgaggctttgttgagaccctctcagctcagtttccttcacgcctgatcctgcattcatgcctttcctcacaggcggcaatcccagaagcactagctaagaagcttcccagatgctcatctccggctcagagtctgtttctcaggggccctgatgtaagacaaagggggtgtctgtgtaaacatgtgtgtgtgtgtgcaggtgcatcaagaatattttctgtctctttaagtctgctcctgaaagtgcccaccctccagtgtcccaccttgccctgcatattctcctcattccatagtttctcctcatgttctggccttgtcagcctttactggctgctgaattttaaattccatcaccttccttaggaagtggtctgtgtccaggtttggggggaagggagtaggggagtggggctggtgacttaactggacatctcaacaacttgtgagttagaaatttgcagtgccagtgaacaggctcaaaaatgaaagtgttttctttccatcttcattttcgtccaatgataaagcattcattttaagcattccagagcccaactgagtcaaaagcacattttaattttgaaacaacaatctgaattcacttcaacatgttggctgtgttttgctttagatggcggggctataggctgtctttctctggtttttactgctcctgtggtcatttttttcaaaactttcatatgcagaacatacattatttttataaatgaaaaagtgacattttattaagaatcctcccctccccctcccccccacccccccgacacacacacacacacacacacacacacacacacacacactatatcctgttcatgtgcctggcagcgacggtaagaaaaccctaaatgtttctgacctctctgaaatgaacacctcgacagggctcagcaggtggacttaaggtgctttggtcaaggcagaaagaaccattagggaatagggcatatttcaggttacatctcataatctcagaacattgactttttttagtgcaaatgatagaaaagaaggtgtgagcatcacagactgggttgggaaatttcatctgcctttttacagatgttcattaacataacaaaacatgagtgaatgtttagcctgcacccttgtctgttctaagcagagacggagtaaaaatatgtcagaaataagtcaactagactaggaaagacattttcgtttagaaaaaaaaaattgacgtgaaataggcggtcaccaaagaagggccaccatgttttattttgtaattatgaaaatttgtctcttttgacaagtgaaatgaatttaggcactcaggcatggggagaaagttgaattgtctgaaaattaaatcgaaataaaaatgaaaaatacaaatgggtgtttcatattcactaacatgggagtcatcttttagatctgacattttgaagcaatgcctgagaaacctgaaagctcatacctctgagtaagttatggccccaaacagtatagaaataattgagaatgtttgctgtttttaaataaatgcaataaatctggaatggtgtcagcactctggagtgtggagagcactgttctataccttgagatgtacaatgtgctgagatcttgtcgcagggagacacgcatatataagatggcttgtctgtgacagggcatgcttgctcagacacattcacctgcggagaacagcctggagttggccaaagagggaaggtgttcaacagaaatggactcacatctggctccactgggtcctagaggtgtggcccaggtaaggtgcttccctttaaaaagtgaatgttggcacatatacaccatggaatgctatgcagccataaaaaatgatgagttcatgtcctttgtagggacatggatgaaactggaaatcatcattctcagtaaactatcgcaagaacaaaaaaccaaacaccgcatcttctcactcataggtgggaattgaacagtgagatcacatggacacaggaaggggaacatcacactctggggactgttgtggggtgcggggaggggggagagatagcatcgagagatatatctaatgctagatgacgacttagtgggtgcagcgcaccagcatggcacatgtatacatatgtaactaacctgcacaatgtgcacatgtaccctaaaacttaaagtataatgaaaaaaaaaaaagtagtaaaaataagacaaaaaaaaaagtgaatgttggatgggtgtggtggcttatgcctataatcccagcactttggaaggctgaggccagtggatcacgaggtcaggagttcaggaccagcctggccaagatggtgaaaccccgtctctattaaaaatacaaaaaaattagccgggtgtggtggtgggtgcctgtaatcccagctactcaggaggctgaggcagagaattgctggaacctgggaggcagaggttgcatgagctgagagcacgctactgcactccaacctgggcgacagagcaagactccatctcaaaaaaaagggaatgttggtgagaccatgcctcctaggggtgctaggaaaattgataagcactcattaaattgttgctactatggcaggtgtgaacacaccttgaatggtacctggggactttttaataatctctctgcatatgtgtgcatgtatgtggtatgtgggtactttgtgtgtgtttatgtgcatgtgtgtaatttgtccacacatatagttggcccttggcatctgtgggttctgcattcgtggattcaaccaactgcagattgaaaatatacagaaaaaaaattacacctgttctgaatgtgtacagacctttattcttgtcattattccctaaataatacagtgtaacaactatttccacagcatttacattgtattaggcattacaagtaatctggaggtgatttaaagtttatgggtagatgtgcataggtgatatgcaaatcctacgtcatttcatatcagggacttgagcatctgtgaattttggtatctgcaggaggtcccagaaccaatcccacccggatattgaggaatgaccatacatacttcgtgtatgtttactttgtgtgtactctgtgtgtgtatgtatgtactttctctgtggaactgtgtgtgtgcttgggtataatttgtgtgtctgtgtgctttgtatatgtgtactttgtgagtgtgtgaggctccttctaggaccagcagtgagccattctgtgtgcccttacagagctgcacccactgagaagagctcaagagaggacctggtgcattggttttaaactgagaaactgaaatgactgccttagttcctatgtatcctcaggtacactaaatactatatatatatatgtgtgtgtgtatatatatatacacacatatacacatggctgtgtttaaaaaataaactgtgcatacattttattctatattttagaatactagaagctatgtttttaagcgcaattgctttttagcaataacccagtaacattgtgggtatcccagtcattccacaaaactgtcttgcgaacaactaataaggctgagagtctttaattttttttaattcgttccatagtcaagggtggtttagttcaagacaaaaaaaaaagaccctttgacctaacttgagtaaaggggatttgtggcaaaacatattgggagaatcacatgagactaaaaggagaagttgagctgtaagcccttttcctccctgtctgtctcctctctccttccttctctttctctctgaggaaatgtgatctcttagttctgcacattcaccccctgtctaatccttaactttgatctggttctttctgaatggatcctgggctgagttctttcttgttggccagagcaggcctgagctcccagattggagggagggaagccagatatggttcagcaaggtgactgaaatctctcttctgattctggtgtgtgtgtgtgtgtgtgcacgtgtgcgtgcgcatatgcacacacaggtgtgcacgtgtgagaataagaaagagggacagaattggagacagaggcacagggagatagagatagcacagacaaacagcacgagaaggtagaaagagagagaccgagagacagagaaagagacgcccacacacagagatagatatagacggagagggactgcagatctgtatacagaaaggatggaggaacaattggcgtgggtgttaaagctgaggcctctgcttgctggtagaagagctagaataattaatggtcaggccaagaaggggcacaagggcgctgctgcagtgcccagggtcctcagctgggcatgctctacttgtctgagaagggcctggtgggccaagagcaggcaacttaggctactgtagccagccataccagtgggggaagtgcacggggctacgtggaagctgggcccggtgggtcctgaccattggccacctttaccctggcaccccgggagtctgtgtcacattgaaatgaatggcatgtgttgagtaaccactatctaagagggcattttaggtggatgaactcattctatctcatttaatttaaaggcagaatataatagttgttgcaggctgaaacagacagacctggatttgtgcactgacggctacttagtaaccctgtgaccttggatgattgatttatggctccctaagcttcaatttctccatcggaaagatgacaataacagttcagctgccttacggactaaatgcggtagagcctgtgacctgtgatgtgcttggcacagagtctgcacaggatccgtgctggataaatgtgagcccatccccagcccattgtgagtgggggcagtgtgatccctgctttcactagtgaggaaacaagatgtgggggctttgatatgactcttctggcgatctcacagctgctggaggcatcaccagaatccagagcttcctaggctgactccaaagccctcaccatgatggttaattgatttttcttttcttttaataacactggcttctcgtaaacagtggcttgagagtttgtaagttagggagtggccagagagtctgcagcctgctggcctgctcctggctagagttgctgttttcttggggtcttgggaaaggtgattcaggctaacagcaatggcattatacctccccacccacccacacacaaggactccggttttggggtgtactgttgttagacctagagccacaggttctcctttaaaattaagaaatttttaatttcttattttttaattaattaaactgacaaaatctgcacattgttaaaaaaatcaagcagaacaagagagtataaagtcaaaaagtagtgtcctgtctagttcagaccgtcaggtacctgttccagggacaaccatagttgtgagtttcctgtttgtagaatatccagattttctacccatttttcaagtatttgcatgtgtgtgtgtgtgtccgtcatttataccaatgggcactgactatgtacacacacacacgtacatcatgcctttctgttctgcttaatgacttatcttagagaatattctatacagcctccattcgagctagtgcattttttattcacctcaggagatggattaggtctagtttattcttttttatggtggtatagtatttcatcatatgaacacagcagaaattatttatatcttctttattgttggataacttcccccctcacccaagtctttgctactgtaaacaattccacaatgaatatatttagatgacattgaacacatttgaaaacatgtctataggataaattcctagaagtggatcccaatgtcagaaagtaggtgcattcacagctctggaagatattagcaaattatttgccacagaggctgcaccaattttactcccattgctaagtgtgaattcttcatctctacttcttggcattcacctcctatacattaacaaacttgttgctgtctgtcaaccaaacaagtgaaaaatagaatctcattttaattttaatttgcatttctttgacattgaatgaggctgtgttgggctttcagtaagcagcatactcattagctaatttttaaattgttttgttattggtacaattatgtatatacaattagttaaacgcctgtgctgagtctcagcccagatagactaaagagggtatttttgttccgtaacttaactaatcgaccagaccggtgaaaaggctaagctggatttctttttgtttttgagacagagtttcactcctgttgcccaggctggggtgcaatggtgtgatctcagctcactgcaacctctgcctcctgggttcaagcgattctcctgcctcaccctcccaagtagctgatattacaggcacgtgccatcacacctggctaatttttgtatttttagtaaagacagggattcaccatgttggccaggctggtcttgaactcttgacctcaggtgatccgcccacctcggcctcgcaaagtgctgggattagaggcataagccacaacgcccagctggatttcatctaagccaggctgaataatgtctgttttttggaccaggactttgcaaacttatttcttaaagggccagatagtaaatattctgggctttgtgggccagatggtctctctcaaaatgacgcaactctgcccctgtagtgcaaaagtagccagagacaatcaataaataaatggtcatggctgtgttccagtaaaactctctacagacaggcgctaggctgcatttggcccctgggctcggttctcaaacccctgttctacactatctgcattagtgggtgtctggagacaacactgacacttcatttcgcagattccaaatggcctgtcttacatacctgtgactctccggttacaggcagaaagatatgcaaactagctgatcaaatggataaataagagtctgtgtaaataagagtctgtgtaggtgtttggacatttaggatgttaggccttagaatcatgtcacccctgagagtgaatgagaggctggaaggtctaaaattttcccacttgcatgcatagcttgccctttgaattgttaatataatgtctttataccccgactacctactaacatattgaatctaccctgctgcacaccgtagtggcatggagatgcctaaaactattgtttagagaatgaaaagagccatcctgccactccccaaggtcaagcagcactgctttgagacccctgtcaagaagaaactcggggccaagggaagcagctcttagctccagaagggagtgggccttgctggccaggaaacgagtacccgtgttcccatgagggtgagcattgtggaagggtcgggggtgaaggagggactcagaagaggcaggaggcaaaggcaggctctgagcggagagtggcagctggtatgcagagctgggtggggccctggcaggtacaggagctgggtggggtcctgagggtgcacaggagaaaccagaggtgatgggactttggtggatttgggttataaacatcacagtggggatttgaatgaaggctctgatatgtctgctttgttatccatgtctcgaacagtgaggaatgaatgggtaagtgaatgaatggaggtaatgagtactaaaaatatggactttttacaatcacaacattatccatttaccctatgaagtcacatgaacagtgcctggcacataacaagtgtacagagtgcagtgcatagtagtgttaccagctagtgtcacagctgatgggaagtataaaggcagataataaaggtgatggcaacaaaagtttattgatgctgtatacatgcaagttgcagttctaaacattttagctgaattccctcattttatcctcacaataaattaagaagagggtgagtcttaccattaatccattttatagatgaggacaccaagtcatggggcggttaactaacttgcgtaaagctatgcaagagctatgtgtaaagtatacctctggggtttgtttggagaggtggctccgaaattccacggaacatcagactcccctggagatgtgttaaacccagaccactgggtcccacccctggagatttggattcagtgggtctggcgcagtgcctgagaatctgcatttcttacaaattctgtttgggttctgatggcctgggagccacacgtcgagaaccactggtttagagaattttgtgcaggccagtttagttcatttctggctgttcttgaacccaaagaacctttccattgttttagtgttaccgtccctcctccttcgcccctccccatctccagggcccctgccaattcaaccagcacagtcacaaactgaacccctaggaaaagacatcgagtcgcttgcagaagcagtgtgttttctctctgggaggtattgaagcgttgaattcaagggccgggctccttttcagaaatgatactccatagttttaccgcaggcggctggagtgtgcttgggctctgcctggaacgcaagctcgactcttctccaatttcagtgtcttaccctcgcaagtgctaaattgccccataaacaaaacacatctggtgtttgactcatggaaaatatttctctatggttgaaaagagtgtggatagtctgactccattaatttccactggagtgactccggaccatctgcttccgactctgtcatgggggaggtctggaggcccgggaagtgcagtgtgggctccatggagctgtgggtaggtgtccatgtcagctgtgcccctgtcggtctgagagatgcttcccaatgcaagtctgcacaccctggacgtttctgaggctcctcagacctacaggagcactctgttcccagtggaaacggcttggggccccagttgccttgttctccctcactgggatctggtagatgggctgctgtggctgtgatgctgtttccaggatccctgtgatatctgtgtggccctacacggtggacacttcccagtcccttcaaatggcccttctttctcaatcctgggatatccatccaaggcttacaggaagtcagaggggctccctctaggggcctctgggacccagctgttcggagagaggaagaccttctggcaggtacatagataataagctttactacagcagaaataaagggcagggtgggctttgcatggcacagacttgggttcaaatctaacttctccttgccgggtccgtgtgtcctttgccaagctattagctccttgacctctgtatcatcattttaagaaggagtactttttacagtaaaatgtgacaatttgccagttgcatattaagtcacttgaataatgcctggcacatagaagatgcggctgttaatattatcagttactgttcttagaattctggcaggcataactcaaagatggacccaagatgaccaccccctggtgtgcacaccttgtataatcccctgcccttgagtaagggcagaaccaatgaatgtgatagcataggactttgaattaaccaaggagattaactgggtggtcctgacttaatcaagagaggccttaaatgggactggccccttcctgaaactggagagcctggaactatgagagggctgatgggaggaaccacatggcaaggacctgagagtgacatctgcttgccaagagtggtccacagccaacagccatcaagaccacagggaccccagtattacggccacaaagaagtgaattcagcatataacttgggtagcttggaagcagtctgccccagtcaagcctccagatgagaacacagcccagctcacatcttgcttttagctttgtgaaaccctgaacagaaaacccagctaaagtgcaccccagtcttgacccatggaaactgtgagataatacatttatgttgttttaagccactaagtttgtagtaattgcgatcacattagaaaatgaatgcagagaaaatatcatccacttcagagacaggtaatgagaaataaatgtgataatctgtgcagagcatgccagacagttgcatagtaagtacggggtcatagtagccctgggtttcagcatctgtttcagtctccctcctagttacagatcatgttcccagctaagtagcctagttcttccccaccaggaacagactcctacctcgaaaccccagcctattacctggaaccctgctggattcctcctgcttatcctcttctcagcggggcacatggctcagctgtgggcatcaggattcagccatggcaagacagaggcagggaagtggcttagagaggaacaagagagaagactcccctctgcagtggagatgagaagtacccagctgcccgggtatgaggcaatcccatgagaagattcctcggaatctgctcgtgtgctcaggcaagcctagaagggctttccctgggtatctcaccctcctgaaggtggtctctatggcctacaccatttatccaaggagttatggagaaggggaagagatggggcaggggagactgactcctggcccttcttgcattgcctgaggtccctgtcctcactactctgagcacatcagtggattctgaggaatcttctcatgggattgcccagtacccaggcagctgggtatttctcagccccactacagaggggattcttcatcctagttcatctctgagtcacttccttacctctgtggctgcagacactgcacccagacttccaccactcctctccccaaatcccgtgttttagcctgaacagagtcaaatgcttatgtacatttcatgaggacactggtctagagggaatcctggtgacctggtatgatggagaggaaagaacataggctttggtgttatacagagaagctattcaaatctaagctctgctaattgctagttttctgaaattggcaggcagtagtttctctaagccccagtttcctcctctcccgtaaattgggattgttacatccctatgaaagggtagctgtgagggtgagatgagagaatgtggctcaggtctggtacatgaagatgttctgggcgtgtgcgtattctccccatctacccctttctagctctgaatttagaaactttctatggcaagaaaagcccaaacacagtgtagtgtgagcgatagatggagagagaaatcagatcgtgggtccagcctatgaagtcccaggttggggtcccaagaagtcctcggctgtggggcaggccgggtttacatttctttgccctttctcaggcaggattctccttcccatggagcatgttatcaccaatgggactatttctgtattcatccaaagcttctgattagaggctcatgaatattcaaatacctgcctccccttatttgcctgactattagcattctgtctctaggcttattttgtgtttttttctgttgcacatttgttcagtgattcacgcttcatcatccaatgtgaccagtttcgagacaattctggctattcccagtcccgggcaaggctgggtcctcaccgtgccccggctgccagcttctccttgctctttctgctcccaaagatgggtgggtggtggaacagcctgcagagtgctactttggaaactcatttctgggattttaaaattcatattgataataataatccactacatgtgtctctcacttcaaattttacaaagatatttcatatcatcctgttttacagtctggctttctgaaaatgcaaaatgctgacattcttttctgaatgaggccatgtctcttttccttctgaatatttaacaacaagctttgaacaaaacagaatctgttttaaagcccagctgtaccatgatgtctcacaatggcacaaagtagaagggaatttgtctttctctctccctattgggagaaaggttggaggttgctttgaagtccatttagctctgtggggaacacagtatgaattagttttctatgactgctgtaagaaattaccacaaatctagtggcttagaataacataccttgattcttttacagttctggcagtcagaagtaagaaatgggttgctgggctatgttccttctggaagatccaggggaaaatccattttcttgtcctttccagcttctaaaagccacttgcatcttttggttcatgactcatatgttagggttctctagagggacagaacaaataggatatatgtatatatgaaaggagttgattaaggggagttgactcacacgatcacaaggtaaagtcccatgataggccgtctgcaggtcgaggagcagggaagccagtggtggatccatttgagtccccaaacctcaaaaggagagaaactcacagtgcagccttcggtctctggccaaaggcccgagagcccctggcaaaccactggtgtaagtccaagagtccaaaaactgaagaactttgagtctgatgtttgagggcatgaagcatccagcacaggaaaaagatgaagaccagaagactcagcaagccttctctttccactttcttctgcctgctttattctagctgtgctggcagctaattagatggtatccacccagattgagggcgggtctgtctgtcccagtccactgactcaaatgttaatctcctttggcaacactgtcacagacatgcccaggaacaatactttgcatccttcaatccaatcaagttgacactcattgttaactatcacagcccctttctctatcttcaaagctgaccatgaagcatcttgaaatctctttctctctgacttctgcttctgccatcacatctcctttcctctctaatcttcctgccccttacaagcaccctgtgcttacattgggttcacccagataatccaggaaaatctccctgtgatggttaatactgactgtcagcttgattgggtggaaggatgcaacgtattgatcctgggtgtgtctgtgagcatgttgccaaaggagattaacatttgagtcagagagctgggaaaggcagagccactcttaatctgggtgggcccaatctaatcagctgccagcacagccaggataaaaagcaggcagaaaaatgtgaaaagactagactggcttagcctcccagcctacatcttcctcttgtgctggatgcttcctgccctcggacattggactccacgttcttcagctttggaactcatactggcttccttgctcctcagcttgaagacagcctattgtgggactttgtgatcacgtgagttaatactccttaagacatggatgaagttggaaatcatcattctcagtaaactatcgcaagaacaaaaaaccaaacaccgcatattctcactcataggtgggaattgaacaatgagatcacatggacacaggaaggggaacatcacactctggggactgctgtggggtggggggaggagggagggatagcattgggagatatacctaatgctagatgatgagttagtgggtgcagcgcaccagcgtgccacatgtatacatatgtaactaacctgcacaatgtgcacttataccctaaaacttaaagtataataataaaagaaaaaaaaaagaaactcccatttatatatgtatctatcctattagttctgtccccctagagaaccctgactaatacactccccaactcaaggtccttaaatgaatcacatctgcaaagtcccctttgccatgtaatatgtcatcacagggacatcacatggatatctttggggacccattctactgaccacactgtactgggttagtaagaaaactgctttctctggcccgaggcctacctgtgtgtctaggatgtggctttcctggcattgcttcttcctctctgcacagtggacttgtaatagatactgtgagtttctcagctgcagggtaacagtatcctcagtgggcccatggagggcaggttgtggtgcattcagcaacagatacccaacttcctagccagagctctgtgcgcccaaagcatcttccttaaatgtgacacacccagttcaattctttcaagtccctctgaatcaggaaatatcatgttcagttaaagctgagatgcagagatgttaaataatgcgctacgtgtctcctgtataatatgattcatgaactctggtgccagacaggcctggattcaaatccagatctgatgcgttgtgactttgtgcatgttattccacccctctgggcctccatttccccatctgtaagatgaaaatacagtacccatgtcacagttgttgtgagcattaaatgagggaaggcttgtaaagtgcttactatagggtctggatcaatacatgttggctgtttcatcataattattgttaccattaaggttagcattatttgccaggcgtggtagctcaagcctgtaatcccagcactttgggagaccaaggcaggcagatctctaggtcaggagatcaagaccatccaggctaacacagtgaaaccccatctatactaaaaatacaaaaaattagccgggtgtggtggtgggtgcctgtagtcccagctactcgggaggctgaggcagaagaatggcgtgaaccagagaggcagagcttgcagtaagccaagatcacaccactgcactctagcctgggtgacagagcaagactccatctcaaaaaaaaaaaaaaaaaaaatagcattattttggccaggcatggtgggtcacacctgtaatcccagtactactttgggagcccgaggcaggtggattacttgaggtcaggagttcaagaccagcctggccaacatggtgaaaccccgtctctactaaaaatacaaaaattagccaggtgtggtggtgcgtgcctgtagtcctagctacttgggaggctgaggcaggagaatcccttgaacctaggaggtggaggttgcagtgacccgagatcatgccattgcactccgacctgggtgacagatcaagactccatttaaaaaaaaatttaaaaagattggcattatttttaagaaatgcattgtttttgctcctgctagaagttgttacaataataaccattgaaaattctgttattattgctcccaactggagacatgaacaaaggtgattccctgagatttgtggaccctggaatacctgttttggttgaacatggcccatacaacatgcacagtgaaaactgccttgtgtacagtcacacttggttcctaagccaagttaggatgtaggtgcagctacttttctcatgttgtatatgaaggaaatgagggaagttaagtgattttccaatgacaatactaatattaatgggtgaaatttgaacctcctggggtctgtcagagcttgggatcctaatcctacacactctgctttatggagtaggtcctgatagatagacagcatagcctgtgttttcctgcccacctctgatgctaaatgcaccctgaggcctgagaaccaggtgccaattaaagctcattaggataccattgtctcaggcagaaatcggtacttctgattcagtccccatttcactgggctcctgtcccacagaatgatgggagcagtgggctctttggggcgtttccttaacctgcccagagctccttcctcatatatgtccttctagatcaccataaaagtcaacatttacattgaagctggtattaatgccaaagcacggggagttttctctaaaacagaaaatgtccaatttctaaagatcaggttccagcacagataagtgttgacttcagcccttctgggagctgctgccatgcataccaacagggtcccggcgctgtgctgagacaacccacgcttctaacagggtgtttgtcaacaaaaggatctatgtggggctcgaggaggtcttgaataatgtataaaatccacacgttaaggttgattaaaatcctaagtgcattatccaactggagcaataaagctcttgagatctctgatggctgaaattcattgatcttcaaggacttttgtccttacagcactgtgagacaatgaataccagggacatcaaatccatggcgagtccagcactaaggtataacgcatagggacatctccaagtgaattcatatacaatgggaatattgcatcatatatttgatcctcatatagccagaaataaaaaaatgccaggagtttatctcttttgctaccttttcatagacacaaaataaaagaaaggaaagtgtgagaagccagttactagggttttgaggagcacgttccatgcctcatcatatgccacgtgcttgattctcaagatttctactgccatcagggaagctttgacctctgatctggctcgggagaaacagacccataaactggtgattcctgggagagtcttgtttcatggtgcaccaaataggggtgtggtttcccattagaaaaccactcacaggaaggccctgagaaaggcagattctgggatagccagactccagggtaaaaacttgacctttgccttggacactatgtatgtcctctgcctgtcccaccagtgcactttgaaagcagataactttttgtctgatttcacaggttcacagatggagaggaattttgctccaggatgattcatagcccaagtatcactcatacatggtttagacgattttagatgcaattttggatttagagttgaagctgaaatgggttaggaaatttagggatgcagggatgaggtgaatatattttacacatgagaaggacatgagttttggagagtaaaagggcagcatgttatgaattagattgtgtcccctacaaccaaatttatgtgttgaaatcccaaactccagttcctcagagtatgacctgatttagacataaggtctttacagagtgaatcaagttaaagcgaggtcattagtggaccctaatccaaatgactggcgttcttataacaagaggaaatttggatagagacatgaacatggggaaacatcaaatgaagatgaaataagagatcagggtgatgtttcttcaaatcaaagaaactcccaaccttctctcccaacctctgaacaacaagccaccagatgttgggagaggggcatggaaccaattcatcccggcagctctcagaaggaatcaacactgctaatattgtgatctcagatcaacaaaactccagagctatgagacagtacatctgcgttgtttaagccactcattttgtggtacttttatggcagccttagcaaacaaatatatattttggtatgttagctgagggattactttgttcatatgaaatttgataagtccatcatggaaagcagataaaatctctgggtgaagtggactttgagaacatagagactttcctcccctgttcccgtctccctaaagtggttctggggaggctcctgaggagccctgagactacagtttgaaaattgctgactgctctaaggatagtaaacaacgctgacataatttgacagcaacagccaactagtagggctgcagcagctcctggaagcactgtgtgaaggaggatttggaggcttcactcaggctcaagagtaaagtgtgcagtgacttattagtgatgtctgccacaggcatgggaattgtgaggggaataatcatggaacaaactaactattttccattcctggaccagtgcactcatgtggcagaaaggtcaagtgactgacttaaagctacatggctcttttggaatcagatgtactgggtggtgtttcaagaccagatgtgtgtgagatttattcctctgtctatagatccacactgagtcactgacaaaggcctggtcattcattcagtggagcccagctttccacagtcgtttgactctagggccaaggtgtgcacctgcttttattcttctcatattgctggttgtactgtcagaatttcctttatttttctctctctcaaatttctgtattgggctttttctgtacttgagggtactccttcccctccgggaagcattggcactagaacaatgattttcaactggggatgattttgtcaaccaggggcaataattggacacacgtttggctggtgcaacttgggagaagtgctactggcacctcctgaatggagattagggatgctgctcgacagctgcagtccccccagcaaggagtggccctgccctgaatatcagcagagccgaagttgagaagccctgctctatcgttagcctccctgctgcccatgcttccagaagttgccttatttttccactttctctttcccagagccccagttcccagagtgtcctctccaggcaccttcccataaactcgccagcgcacactgggcaggagcagggggccattctggagatgcctgagaagggtgtgtcttgccagtgttttgaccacacctctctgaggagaaccactaaagcctgggtcccttgaaggaacatattctgatgaaggggcatcacaaggactgtaaggacaagctgttctcctgaaagtcatcctacagactccagttctctcccagtggggcgtcactgccgtctatcaacccctggatattggtttaagaatctcccccaccggaggagattgtctaatttgggacttgggtaatggagggaggctttggttagccatcttggcttattccacagagcttcttgtctctatttctggaaaggaaaaattactttttagagaatcacagaattttagaaacaaaggtttttagaagctcctgttaggggctgtgacaaatccgaaggttgatggtatctgacatggttcatttacacgtctgttgtctgttgtctgtctccactactggatgtgagttcctgaaagtcacgggccacgtctttttcactaaagtatagtcaatgtccagcagtgcactggcatgcaggacgcacatatacaagtttgctgaattaatgaatgaaggcactgattaagtgggagctggaactaaaactctacttgcgtatgtgtgtgtgtgtgtgtgtgtgtgtctgtgtatctgtgtgtgtgttcagacataagaatagtacctaaatagatatttagtagggtttccataaatacttgttaaactaattgttggttgctgcggctgcttccatctctgtgctgagcatttgacatatgtaactcatttcattgtcaccctaaccttacaaggtgggtactagtctctccattctaaaagtgaagacactgtgctcagagaggtttagtaacttgttcaaatcacagtgccaaggagcaacagagctaagatttgagtcttgctctggcagtaaaatccaagcttgtgtgtgctactccccgactttggagttcaagcaaggacatttggggcccatcttgtactccgtgggaccattgggatctttgcacagagacaggcctggtgaaaccagcatttgggaaggagtattggggagcaagggtggatgcaggaaactgctgtcttaccctgggcagagttatccagacaggagcaaggggaaggcaacgagatgggtgggcgacttgaaagaaagaaagatttgcagaatgtgcagggcctgggggcttggaatgtggaaaataaagctatcctgggaaaagagagcaaagttaggagacatgggcatagggacagcaagatgctgagttgattttggagtatgttgagcttgaggctcgtgaaacatctactagagggagacacaacgaaggtaataggatacttttgctatcatacggtagaacccgttaaaaataactcatgcttaaaggagcatatgttggattgtataactgagaaagatgtagtgctgcctttagccatttgtggatctaggggttcaacgaagactccaggtctccagttttctccaggagatataagcttgaggcaactgatggccatgatatctgctcaggatatcatggccaccagttaccccaaacttacatcctagcagcctagaaacttgtagaggcagggggagagaaagagacagaaagtgaacaaaagaaatagaaagagatagggagagagaaaaatagagattgatggattacttgggtggctctaatgacagcttccagaatcccaggtctctggcagtcaatacccctccaagtgtgggagatagggatctctctactggcagcccctctagaatcacatacactggtcagttagcacgtccccagtgagaggcatgagagataggcagaaacataaccagcatccactctaatgcgtggagtggtgttcatcgttcattctgcaaggtgaacatcctagaaaggggatcatccagaaggcaggatcagaggagaggctctgagttcatgactttacctctccccggcctgattttaattttaagaagcaccatctctcagccttttcttgtttcccttcttgactttgtgtgtctcctggtcacagggcctgcttggcaaggaaggaatctaagaagaagagcctaggctattaacacaggtaactgagagtcgatgtatatgaaaaggcagcagcccctttgcagttttattgcttattttattcacagttacctgcaatatggcatggctgcagatggatagaaatatgcttcagtgtaacacatttacagcagggggagaaacggcccccaaaacacaacagctcaatgccaaaagcagactttgcatttcctagactgtgctgctttctgaatacaaagagacagatgattattgcagtaatggacaattaagctgtggtcagacactcaagaagtactttaaacagttggttataaatataacatcaaagtattatgattcacaggagaggaagtttacagcagatcccagtaatggtgtctgagatggcacgtagagctaggattcaaagctgggcaaatgtaggtctttggggcaaatggtgggatagtctgggttggattaaacctgaactttctgagggcgtgtgatggacatggagttgctcaccaatgcctgctttgggaaggattggtggccccagctgtgtggtcaaaagagccttcaggtgatcagcgttcttcgggggttgcctcagcaggagggccctcagacaagagtgattgagaggggtgtgtggcaggctgagccatggtgcccccaagatagccacaccctgatccctagaacctgtgaatatcttgctttatatgacaaaaggctctttgcagttgtaatgaagttaaggactttgagatgtgaagattatcatggattaactttgtgggcccaaggtaaccacaagggtccttgtaaggaggaagcaggagaggcagagacagaaaaggagacgtggtgatgcaagtggaggctgcagtgttgtgctctgaagatggaggaagggaaatgtaggcagcctctagaagctggaaaggatggatctccccagagcctcccgagggagtgcagccctgcagacaccttggttttagcccagtgagccccgttttgtatttctggcctacagagctggacgaaaataaattcatgttgttttaagtcactgggtttgtgataatttgttatagcagccatgggagatggatttaaaggcccagccattctagcccaaggcaggatgatcgaaaaggcagaccattctggctccagggtaccctgtggagtgagccggggcagttattgggtctttttccaagctcaacttctccctctgcccacttctttccatgcttccacaggttttgatcccaagggcaccctctaatagacatgccaacctacaaacactatatctgagttggcttccacgggaacccatgctgtgatattgtatacctgataggtagtatcctacagtgattcggaacatgagtgttgggccagtctgttctggctccccaacatgataaacttgggcatgtttgcttgtctttttaagccttagtctcctctcctgtacaatgggcatgaaaaccacacctgcaaagaagcttgtaatgaggatcaactgacagccacctggaaagcacatggttcaggcctgccttgagataagctgttgataaatgttactgatgagactgatgatggtggaattgacactgatggaggttgatggtggggatgctgatgaaggtgaagagagtgatgtgagaactcccagggcttgtggacacgtatctgatttacagaagataatctaaggagaaagctcataggttctcctattggtgcccaagagggcaagggagagaaacactgaggaaagaaccttatcaggctgatcttctaccttcctcctgcctattcttaatccagagatagactgctgagttctgggctggatcctagtctctgagctggaatccagatattaaataccaggttccagactggacatcagccaacctgggagctgttctttgggattccttctaagtttaatttctaggacttttctgtgccaagatcttgactcggattctactcccaaagacagagattagctgtgttgggtctaagggcattgaagatcatgctctaccttccccaggaggacccagagcctgtacctgaggctgggaacaggggtcatgtgaggatcatgtagacagagagaagacaggaggcaccttttaaaggattatctgagtttacatgacactttttcttttaactcgaaaagaagcataaactacgttcatggatctcaactgcagattctcccttctgccccccaaaaatagccctttgaagggtatgaaaaatgactctcctgcttttgttcctggcctcagagagttcagcctgtcagaaacgcacactttgccagtgagctaccagggatgcttggaacaagaactgcccccaaaatgccaggggacccaaacttggacttaattcacagttcgcaagtcctcaacatggggctagctgaacaatttcaactaaatgaaaccctgcatggttctcctgggctgggcctgtgggtgccatgccccagctgtcagccccgcttcacagctgaagataaatcacagcagaaaatggagtgtaatgaaaacactgacagacccttcaaagtaatggagctcgggggtctcccttttgttgcattccgtatattatgcaattactgccttggaaatggccttttcttcattcctgagaggtgtgtgtccggctatagaatggaaagatgctttcatgcttgggactgtgtgcaggttggattcagcctgggccagatctatccttcacaattggcagcaattttccatttcacggaggctgaaatcagccacgtctaatcactagaatcactacaccaggggctgggcagcgcaaacaggtcagacatccctttaatctgcaattgagttgttcacaccccaggaaatagattttatgctgctttcctgctctgtacaatggggtgtggttgaggaaagaacgacttcgcaaggatgcctgttgagttgaccgtgtcaaaagtcatgggtgggcggcatttagtacctttaggggagggtctgggcacagtggacactgtttcatggtacagctggggtgttccattaggacatgaaatctttaggaaactctgggctattgcctctctgtgacctgcctccggctttcttaactccccctgcctctggaagcctctaactctacaacaagggggcttcctgttggcagcaagtgaaaatgtgtccccgaggaagtgctggggttctttcaaaagggaaacacccttcaggctgacttcagttcaaaaacgaaatatatcgcataaatgtaaagttcattcatattcacgtacagctggatccagaaagcgaactgatggcttcttcatgctggcttcatgcccaggaaagccctttcccctgggccctggaaaatttcaggctcccatgctctcaatcccagaactaatgggataaaaagagatgatgtattcccaatagttctaacatgtttcggaactgagacccatgaactgactgggtaatatgatctaccctaaaccaattgctgtggccagggagatgcaatctactgattggccagggttagagctgtgcccatccctgagccaattgggtggtgaggaaattctggctctgactgaccaggttcaggccatgcctccttctgaagtaaatggtggtggagggagtggagtcagaccatttcaggacatagatggggtttggtagggtggtttcctaagacagtaggatgcagttacccagagaactgaaaattagatgctaggcatgcaaagatgaaaattggtccctggagatgacaccaggtctgtagaaggagctggcaagtgtttggatgattttcttcccaagcaggtggtcgccctcggtgttggatgtaaccttgacccctctcagattcttttttgactacctctgctttgttttctcccctatggtcacacctcacccacacttcttgttcttccatgtctagatgagcaggaggagcacactgtgggtcctgggatatggattcccgaggggctgccaaggggctggagggtgaaaattggaagggtgaggagttagctccctttgagggaaggggaatgggaggcatttggaggcaattggagacgtagatgttcctgctccttccccctctccatgagctccctttataacctccttccagagaagtgttggattcccagtgaacgtgcctgctaagagctgttctattagactcctcttgtggcaataataaattaccgcaaacttagtgacttaaagcaatacaagtttattcttgtatagaatatacaagaaagtataaaatggaagtcagaagtataaaatgagttggcagggttgcattccttttggaggcttaagaatccatttctttgccttttctagcttctagaagccatctgcattccttggcttatggccccttttttgcatcactccaaactcttgcttttgtcatcacatctcccctgactctgaccctcctccctcccttttataagaggccttgtgcctccactgggcccgcctggctaatctatggcacgagtcttcccattgcaaaagccttaatcacaggcaaaaatcccttttgccacataaggtaacatcttcacagattctggggattaggatgtgggcatctctggaagaccatcattcagctgaccacagcttgtgatggctttctgagcctcactgtgaagctctggacagtgcaggactgcattgcattgtactgtgttgcttttgtttgtgtttgcctcacttccccctttctttttcaacctgaccacctggggtggcgcattctaaacaatctgcttctctttgatctttgccccaggcttcattttctgaagcaacagggtaaaggaaacctccgtgggttcacagggtgccttgcatgtccttctcttgcagcacatcaccctctgcatgaccacttgttcattgacatgtctggacaatgatccacgtgcaaaaaggagtcctgtctttctcatctgtgtcttcagcccagggataatcaagtaggtgttcattcttgaataagggaatgaatgaatcagcctttaagctgccctggaatttttggttcaaagcttacttgctctggaaacacttccattagctaaacttctaccctttagtcacagctttcttgacatcagtgcttggtatgtgtgcacacattttcatgcttcagtgagtaataatgcacatacccatgctcaagtgcagagtcaaggaaaaggaggactttgcccctcctacctatatataaccttggactagttattttaccactctccacctcagtttctttgtgaaatggggctaataattacatttattccatagaactggtgaaatgattaattttgatgatacaatagaaagtactgaaggcaatataacccgtctgtagtttcccaaaatgccaatttcaagaacttcttgtgtatttgtagcacctaaatttagttggtcactgcaggataaatcttgtatgacttctttataaatatgtttcttcagtgacattttccaaatggactgctttctagactgtttgtcttggctagactgaccctcctcctccacaattctttcttttatgccaccttctggttagaggtagccatgtgtcagagtcctggacaactcagtataaaccaaaacctgtgggcagtgccttccagaaagcttttttattctttattgaaagggtcagattcagtcagaatatatcatcagcctttgcctccccattttcttcctgtatcctgtagacatgatgcctggagctcctgcagccattttgtaacatgaggccctgagcaccagaaaaaagagtaagaatcttagaggatcctgtccttgactgacagtgacccatgagccaacatcgccagtggtctacctcaagacttcttctttgtgccttttcaaggataataccagaaatttggaggagaggataggaaatataaatgcaaccaaaaagaaagatatcatcaaagaggtctgaatctctctttggattttaaagaattaaagaaagaaagggggactcaaaacaaaaacaaacctctacccatctcccacagtggagtggagccaacttgaaagcagtgaatgtatctatctggtggttggtgtcttctgtacttggcgttttgcctgggatggtagtgtttgctgaacaaacaaaggaatcttttttttttttttcctcacctcttttaactttggccaagtctgtctggcccaccagagcagctgtgatgacagttgtttggtgaatttccaaacactgtactatttaagtatggcacacagtcttagggggccaggcaagcaattggaaagctgaacctggctggccagacctgtgttaccaaaactcatatgtttcatttggatctttaagcagaaaaactttccaaacccttgctccaatatgtaattctccgtggctgatttctagcgaggaaccaaatttaaggtggatagaagaagcatattcattgaaggattggtctgtgttccaaggattgtatgatctaataggggtcatatacacgtcagtaattttcaggattctacctgactttttatcctggacaccaggtacagctgccagcatctcttcacagagcccctgtttactgtgacttttcaaagggcagggatagtttcctagtggccttggaatgccttctttcacagcaccaaccccataccttattcacaatgggggtgcacagccactctataagagagaagatcaaccttagaacgtttattaatatctttataatttcttatagttggggggaagcaaaggcgaaagaacatattcttgagtaatttattctgttccctggcattgatgaaagggataaaattaaatcagtgtttctactcaagttgtttgaaggacaagccaaaatcacaccattaaaagttaacatctaaaacagattgtacattactagggatgagttcagacccaaagtagaagaattggccaaatgaatctatagaatgttggttgtgaggaatttactaccctcatttccagtggttaaaaaataaaagacagattatcttcatttcaggccaggaaggtttgcagaaagagccaaggatatcttatccaagtttaacagggaatgaggtaaatggctaaggaaggtcagagctgcgaggtttttctggagcaccaaattcatcacaagtcatagacctgtgaaattcatgtcaaaattaccagattgtttcccttcttgaaggtacttaaactctagcggaaaataggaacatctgtttaatttctgatggcctaaacaacttactcagtacctattgtgtacatctattgatggtatctttgagtgtgagatccatttatctgtccattcatctattcatccattcatccaaccatccatccatccatccatccacccatccatccatccatccatccatccatccatccatccatccatctgtccatccttatatccattcatccatctatcccattcatccatccatccatccatccatatccatccattcatccaatcatccatccagcatttctggagtacatgtctgtgcttggccctgtgctgaggcagaagatacagtgttggatttgatagagactttgctgttcaagaaattacttcagtgcatagctggagagcagggattttcaacctccagtttgtttatattttgggctggataatcttttgttgtgagggctgtcatgtgcattgtaggatgcctagcagcatgcctggattctacctgctagattcaaatagcacctgccccacctcagtcatgattatcaaaaatatctacagatattggcaaatgtctcctgatgggaaagggcaaaattgccttcctggttaagaaccattgctttagagtcagaaacctaaattctattcctgccttacctctgactggttgtttatttgactaatggttatttaactttttcttattcccagcacccaacacagtttctggcagaaagtaggtatgtgtcagtgcttacagattaagtgaacaaatgagtaaattaatgaataagagtctatatttctaagaccagccttttcctaagcagttggcaggctgttaggaagaccttgagccttgaccatgcacagtgtcaagaaagcaacatattcactcaaaatgtgcctcaagtaggaaaaaaaatccactttgggggtatttagctgtgtaagcccgacagataattgagcggctggatttttcagtttcgacagattggtttgccattctgtagccacaataacagagcaaagtaacaatcgtgtctatgtttaattttctgaagagagctgcatcgccgaggctaacaatctggccaattaaatgtggccgattggcactcccacacaagtttgggggtatttaaaatagctctctgcacaagaaaaaaaacatccaagctgcaaagaaagttgtaactctaccaagatttcatatttcaaaagcaggcttacaatggtaaaattgttctgggtgacagataatagacaagccatctagtttgagtgtattagtgtcaaattgagagttgtctctgttgccagtgatggtgtctatttgttaaattggataatttttcatgttcaatgaaatcatcaagattccactccttgtggactgagtttatgggacttttaaccatgttaatcattcagaaggaccaagaggaccaagagtgtccctcactaagcttttttttttttttttttttttttttttttttttgagacagagtctcactctgtcacccaggttggagtgcaatggtgccatctcggctcactgcaacctctgcctcccaggttcaagagattctcctgcctcagcctcccagtagctgggactacaggcacccaccaccatgcctggctaatttttgtatttttcgtagagacagggtttcaccatattgggcagtcttgtcttgaactcctgatcttgtgatctgcctgccttggcctcccaaagtgttggggttacaggcgtgagccactgcgactggcctcacctagctttctttactaccttaaagcttaagtgaggagtagctgataagaatggaattaggttccctacctgtttcactctcaaatcttctaaacacaattcttgtaggctcgtgttggggaggctgtattagttacctactgctacaataaaactgagtaacaagcaaccataaagcatcattagcatagggcattaacatttgtttagcctggaaatctgcagggattagctgatcttgactggacttagctgattttgagtgttccatgtatctggggttggctgcaggttggttaatcggctctgctgatcttggctgggtttgttcacctgtctgggggttgaatggctgttggttgatctaagatagtcttggccaggttggccaagtttattgggatgcccttcatcctcctgggggatagctgggaaatgtacatgtggtacttgcaggtacaataacttgcattatcccattcgccaaagcacatcacatggctgagctcagaattaagaggtcaggcagattgctctgcccagatagagaggaccctgtaaagttacatggccaagggtgtgggtatccagaggtatgactaattgtaattgattaacacatttgttaattacaatttgtactattaccaaggctatactccagaaggtgctgggccctgacaataaagttaaatctaaataagaaaggtctttatagcaatgttgagagatagaggaagagggaagagagagatgtgtaacttggggaaggctcagccacccagctgttatttgagttctattttctccagcttggaagactgccttcacgctggaaaagggagagtactacaaaaatgaataagagataacttagggccttccagtgccttcacaccagaaaagagagtactacaactatggataaaatgtaacttagggccaagtggatggggaaatcatagctagttctttatagagtccgaatttgcagtcccatgggaattcaaacccaggccattgaaagacttgaccatggaactgtggttatgaggcatcatgaaaaatggtaggggctcctaaagaatgtaggttggtttttatttttttaatttattttgtatttttttaagttctggggtacatgtgcagaatgtgcaggtttgttacataggtaaatgtgtgccatggtggtttgctgcacctatcaacccatcacataggtattaagcccagcatgcattagcttttttccctaatgctctctctcactccccccagtcctcccccaacaagcatcagtgagtgatgttcccctccctgtgtccacgtgttctcattgttcagctcccccttataagtgagaacgtgtagtgtttggttttctgtttctgcattagtttgctgaggataatggcttccagtttcatccatgtcctgccaaggacatgatctcctttttatggctgcgtagtattccatggtgtttatgtaccacaatattttaattcactctattattgattggcatttgggttgattccatgtctttgttattgtgaatagtgctgcagtaaacatacatgtgtatgtatctttataacagaatgatttatattcctttgggcatacacccaataatgagattgctgggtcaaatgttatttctagttctaaatgtttgaggaatcaccacactgtcttccacaatggttgaactaatttgaatgtagttggttttaaatggtcgacccttgatactggaaaggagacatttgtctcactgtgacatctgcaaattagtcaattctcaagtacactggagaatacaataccccctaaagtgcagttaaactatctaaaaattcagaatatcaattgttttatacacatagccccaaagtcatttctaaagtgattaaaataaacacctctcaaattgtgattccatcaagtgtcttcttattcatgtcctctcatgataatatttatgtattcaacataataataatgtgaactaatatttatttccttctttgtgtcggccattgtgctaagccatttacatgcatagtctcatttttattctcaccatgatttcatgacatgggtattgttattattatcattttacagttgagaaaacagaagctcatagaatcatatccaaagcttataccacatctgcctgatgactgcttgtgctcttaatcccctcatgttggctacctcttgaaaagatgaattgtaatagggtgaaatagaattctggaattccaactcaaaatatcagaagtgcaaattcaagatttggaaaccctggcttgccagtaattgatgtgattaaataccttagggcttttttttttttttttggatcacaagttcaataggagtcaacagagtgaggatgctgcccagaacacccaagtaagcctccattcctttgcaaggatgcatgcgattctgtactgggacagcgccatttggggcacctgattcattcagtggtatgttggtgcaaaagtaattgcggtttttgcaatttttttttttttttttttttttttttggtggccaaaaaaaaatctaaattattttgagattgattgattgattaacgacacctgtagcttttgttttgcagtgacagaattgtaaggttattgacagtttggagggaaattgacattgacagtttggaggggagttcccactgaaggggaattaggtgaaaaggagttttggaaaccatcatttgtgagaaaaaatttaaacaatggaatatttgtaacctacaacccagaagacttcagggtgatacggataactttcttcggccactgaatgtattccatatggaagatgggacactcttgcttagattcagaaattatagataaaacttacatgatctgttgggacagtggttgcaacctgggtagtgaattggtatgagatgtggtgagctccgtgactttagccatcagacagggatgttttagagagggctgctgccctgaggaggttcttttctgtgtgctgagtcttgaaatgctgatttcagcactttatttagtttgcctgtgtgctcagccatcatacttaacatatagttagggaagtggtacttctgctcaacaaaatcacaaatgaaaatagcattttagaggacagatgttgactcctcactcttgatgtttcgcttcatggagggagctatggtagtttgacacccctgggctctctctccccctctactcacgctctaccattgaaggaagagggaggctagatttttgcactatacaaatttaggagtctgtagagtgcagtgacacacgcctgtaatcccagaactttgggaggcccaggtgggcggatcacgaaatcaggagtttaagatcagcctgaccaacatgatgaaaccccgtctctactaaaaatacaacaattagctgggaatggtggtgcatgcctgtaatcccagctactaaggaggctgaggcaggagaatcgcttgaacctgggaggtggaggttgcagtgagcggagatcacgccactgcactccagcctgggcaacagagcaagactccatcttaaaaaaaaaaaaaattaggagtcataaacataacattcttcgttcagaaacttcctattgttttctcaggagtgcatgagctgcaaaaagaataattcctctattcttttccaggctggaacatcctgtgccctcattttgggtggctgggtgcccaagttcagtgttgccattagtacatggataaatctgtcaaatttagaggttttgcactaaaaatcagctttgctttcacctcaacaatgccctccagtttaggcttatttgggaatgagagcgatgtgctgccttccatctgcctctccctcatcttatgtctcaatttgttcagaattcaggaggagaagaggatgctgcttagcagctcctgaataacccaatcaacaggagatggaatagaagttactgaggtgctacacattgaacgctgactctatgagtctcggggctttccctgcgctccttcctctaagtgtgccaacaatatcgctgcttttaccatccccagttcacagactagaatgatgaggcttgtccaagttagcaagtaataaagcaaatgtcagcccatgtctgcctgaacccctggtcaaggctttcaaatggtgtacaatgaagtgtcttgagccagagaggatattggctgtcagaaaacggaatgcctactagagctctgaggagataagaatgacaatgggccttagctggtcaaagtgattaatggaggaagagaaaaagagtgtggtcaagaagtagtattctctcccaggagtgacaacagcaggaatatcgtcattgtcatcatggtcagatttttcatcctcatctgcaccctaacagccaccatttgttgatctttttttttttttttttttttagatggagtcttgctctgttgccaggctggagtgcagtggcatgatctcggctcgctgcaacctccgcctccctggttcaagagattctcctgcctcagcctcccgagtagctgggattataggcatgcgccagcatgcccagataatttttctatttttggtagagacggtgtttcaccatgttggccaggatggtctcaatctcctgaccttatgatccgcccgcctcggcctcccaaagtgctgggattacaggcgtgagccacagtgccacactacagagtagtgcctactctgtaaactttttaactgctttattgtagtataattgctatttaataaactgtacatatttagagtatacaatttaatgtatcgacatacaaatcacccatgaaaccatgatcacaatcaagataatgaacacatgtatcaccctgaaaggtttctttatacctctttctactcccttcttttttccagtctcccctactccccagttctgtccccaggtaaccactaatctgctttctgtcactatagttacattttctggaacattatacagataaaattttggtttggctgcttttacccaacataattatgttgaaatttgtcatgtgatggtgcatatcaacagtttattcctctttgttgctgagtagtattccattatatgaatgtaccacaatttgtctatccattcacacgttggtggacagctggattgttttcagcatttgactatttacacataaagctattgcaaagacccatgcacacgtctttgtgtgtacataggctttcatttcacagcctgtgtttagtcttcacaacaagtgaaaggcacaatgcaattacaatcccagttacatagatgaagaagctgaggtccaccaaggtcaactacgctgcccaaggccaccagctaatcgacagcagggttaatgtttgagggcagagccttctgacaactccaggctcaaagcccctgcacaatactacaccccacactgagaggaatgctttcatttgaaaaaataaagatgtttattttttctctgtaggaatgtaattctcagcctatctctactccctgtcatggttacctatatcggctgcagcacacagaccctcagaggtcaagacgtaccttcccactgagtttttttcagtctacccatcaactagagataagataaatcctaataggggccaggatcttttgctgtcaagaatatgagattgtatcttcatttatggagtaacttttacaccctgaaaatgaggatgataaaaacaaggcaggtaaagaaacaaagacagtgtacacatccttgtgcatattcacaatgcaggagctgaaaattcggttgatgcaatgaatgtataaagaattcaagctcagctacagaattctggttgaaagttcaattgctgccaatccccttgggtcccaagcaagcattttgagggaagctggcccacatttccctgttcaaatctggtctctggacctctgtcatatgcaccttcctcattctgattacccagttgattgatggattcatgtaccaggcagctactctgggtgaggtggccctgtgagagaaaagactggacacagtctctactccgagggcaaatgcaacagacgaagagctacataatgatgctgcaggagtaccgagcacagagaactgaaggaaccaggaaaagcttctcagaggagatgccatttaattatttaagattttccttttatttatatattttttaagtgcacatgcttataatgataagtgatacaagcagtggtgagctggtaaatttttgacaaccagttctctgagaaaaatagatatttacagacatcgcttattataagtggggatgtatatagcatgtgctttataaataaaaataaaatacgaatattctttactataaatcccatgtgtatagacagttgaattctcacagaatgcttttgctgacttttaccaaactcttgcatccatagccaaatgatagttgcaattaacaagcaagtatatgttggacatgaatgttggttgatattttcatttaggttaacaaaggtataagataatgctataatattatgtaagacaaaagtgaaacaatggaaacatgtcagaacattacttattcatcagtgacattaggcacagctttgctgaattgggtagtaaattttaataacctgaaaaatactttctcaacattttaggctattcacaatataaccgctacagacacacccatttttaattttaatctgcattatgaacatcttctctatcaccttcttaactctaggcagtgatccaaacaataagctgatccctggcttgtagtccttgccaatttctgtggtgtaaatactcccaccatggctggtttcaaaatagcagtgtgacattatggaacacggagctggaaaaagatgtgcagtcccaccccattgtttagtattctcaagagcacagataatagtaaaaatagtaaaataatgaagaaatcataagtattacctatttacgactcatgttttaatataatttattataagtttatataatttaatttttaataatggctaggtttttgttttgttttctgagatggaatttggttgttcttgcccaggttggagtgcagtggcatgatctcagcttaccaaaacctctgcctctcaggttcaagtgattctcttgcctcagcctcacaagtagctgggattacaggtgcacaccaccacacctggctattcttttgtatttttagtagagatggagtttcaccacactggtcacgttagtcttgagctcctgacctctggcgatccagctgcctcagcctcccaaagtgctgggattacaggtgtgagccatcgagcccagcctataatggctagctaggtttaacagctgtctggcaaaattcctgagtgtttaacaatggactcttatgagtcagtaggagctcaccactagatatattcataaagggtaatcatctcccccaaccaataccccctttcctatatccttctgtctcatcccacttgaggtttatacagatttccgcacccttttctttataccaacatgtgaatgcaggctcttgcacaccatacacaagagtacagaagggtcagttggtttctaggttggctgaataatatcataacatacgtgttaccctgcgaggcagggatgaagctgtaagaagtaaattagatcaagtgctgtctctgttttccaacacacatacacaaacacttttacaaaaatggagtcatatcatacccattggtttgttgatgtttttgttagcacagtctttttttctttggggcttgctttgctctgccatctctctgctcagctccaccttaatcagtgctgcaactccatgtgaactgaccctctcaaccacaccataaacccatgctataatcggttgcatattttctgttctttttccattcttacataattattttttatctatgcacacccacacacacacacccacacacacatacaaacacgcataggatttttaaaaaatgttttgttaaaacatggtattataatgtgcatacatctttgcatctggagctttacaatagttctaatctcaacaattgttctaattcttatttatttatttggctgcatcatataatataatatttcttagtgtgaatgtactataacttaatgaatatgccactactaatggacgtttactattttccatattttttccttgttgagaaatgctaataataaacatctctgaatatttctatagagcaaaactgcaagaatgctgtttctgggttgaagggcatgtgtatttttggctttaatacatttatccatatggtttccagaaatgcttcatatttctgccagtgataaaagaactttcccaccatccccaccagcaataggtcttaactctctttttaatttttgcctgggacatgagtgcaaaataataattcgttactttaatttgcatttcttgactaccaacaagtctgaatatattttcatatctttattgggagttgggtttgctattctgtgaattgcatattcatattctttgtttttgtttctgtgggattgtttctctttgtcaatttgtaagagctctttgtacagcatagatattaacctgtgatctgccacctgcattgtaaatgtttcccaattctttgatttctctgttaacttggaaagtgttacctttagctatgtttatatagttatggttgatagttacataatatatagtttgtggttgatgtttacatagacatgtgcattgtgtttcccctttaaaatttagtgatcccctcttggttatgaaggcctttcacccctagagtgtaagtaaatataagttttttgcaattttttgtataactttttatagagagagctttgtttaatccatgtgaatttattttttatgtggtatgagagagtccacctccttattcttttaatccaatagccatttgggcatggttatttactaaataaactacattttcctcattggatgaagatatctctgttgccatatttagaaactttatattcattaggatctatttctggatcttcttttccactgattaattttttgattcttatgctattattatattgatttgtttagagaggtttcatagtgagttttagtgtctggtaaggcaaatccttcatcttaacttttatatatgtgtacgcaaattttagtattcttgagcaattttcaaatctatgtgaactgaagttaattttaccttcaaagcaaagaaaaatgctattcatgttttaataggagtatcattaaattttatatatttatatgtataattttgacacttttatgatactacatttccctaatgaagaacctaatttttctttccatttgttcaaaatctgttttatgtcctccaataagcttttatagttttattcatataggttctatggctttcttgttaaattttacctttttggccaggtgcggtggcttatgcctgtaatcccagcactttgggaggctgaggcgggtggatcacgaggtcaggagttcaaaaccagcctggccaagatgatgaaaccccgtctctactgaaactacaaaaattagccaggtgtggtggcaggtgcctgtaatcccagctacttgggaggcttaggcaagagaatcacttgaaccaaggtggcagaggttgcagtgagctgagatcaggccactgcactccagcctgggcgacagagggagactccatctcaataattaataaatacatcaatttacctttgtatcattttttcactgttgtaaattttaaaattatttccatttttaggtacttattgctagttagagaatctattttcctcttagattcttcttatatcattaaaccttatcaaatactctcactaattataggattttaaaagttagcttgtatgggcattctacatatgcaatcaaatcatcagccaaaaaagtagaattttttctcctcttttccagttttgggctccttatttaatttttcttatcttattaccttggctggaaccatttagaccatgctaatatgttagtgatagtgggcatcgctgtctagtttctgattttaatgaaaagttattcttattttaatatttgttgttactttttgttaaaaagtatttatcatatttaaacatttccgtttgattcctactttttttgtgttttttacttaaagtacatatggccataaaagtttatcaaatgccgttttagcctttgctaatgtgatcatagtttttctcatttattgttgaagtaaaaaattgtgggaataaagtttcttacattataaattgtatctccaaggataaagaggagtccccttagacggaaggagaagagtatatcaggcaaaaaggggctaggggaactattaattaagaaaaagcaaagaagccagggttaaagctagacataaacacagctctctagggtctgaagggtagggaatctgccgcgcaaaatgagcaaatgaggacgcttgggctgtgatggctggaagttcatgggactcaaggtggctcattgcatatgtgaggttgtggttctgaaagcatcagtggttctgatgttttctgatggaggcaggacagcttgcggcattttcaggagctggttaagagctcattagcgatgaaaaagcatgaagagtgacaggtttgaaaaaaaaaaacccacttatctagttggaaaaaggctttatggggagaaacagtgtggaccattctttggcaagtgaggactgaaaaatatacctactgtttagacttcaggagatgggaggttagaaaccaaagatgtagtcagaaaaaaggaaggagttgtttcttttgagcgaagcttttaaactgtgagatctttgtggagcaggcactgctttttgctgttcccagtaacaacacacaggacattcggcataggagatgttatataaatgcctgatgaaggcaggtgggctcaacttagcctacagggagaaggaaaaggaactggaaagagatggccactgatcataaatctttagagtttgaagaaactggaaatgtattcagtcattctttcttttacttatttgttaaatcattcatatttatttggcacctaccatgtgtcagttactctgctatgcagtggaaatacaatgataaacaggacaaattccctgccttcatagaactttccttttggtggaaagtgagataggtgactattaaataaattagataacgatagactgtgagaagtgctctaattgtttctaagctttcatatgcatactggtggtctggggaaccctgttaaaatgcaaattctggcttactcagtttggggttaagctgaggttttgcagttctaacaagttctcaggtgatactactgctcgtagtctaaggaccagcttttgaggattagcaggattatgaaggctacagctaatgatgggaaggggactgctttgcagatggggtagtcagcagatactgctaaagacatgcttttgaggtaagttcggagagagatattgggtactcgagcaaggctaaaaatcaggactgcaaatgtctggagagcatgttgtgagtgtaactgctgggacccactgttgtcttgatggagagcctgaaaacagagtgagaagagatgataaattgaggataatgatactgagaggatttaggcttgtttctgggaagatgggttccaatgagtgagattctcattaactaatttataatgacacacacacacacacacacacacacacactgcctgcaatatgcctatatgatgcaacaaagggaaggttttgcaagtgggagacttagccctggaaagggagaaacagcctctgtcaggagagggcattagacatgtgacctaaaagaggaaagggaggtgaacagatgccggagaggggaaagagtgtccagacaaaaggccctcaaagaactggaggtgctagtgtgactgtagccctgagaagggaggggagcaacagggccagggaccagtccatgcagagcccgtgaggcctgtccgaggttctgtgtataacgacggtgttggtaaggggctggtgtccacttatgcacctacctttattgccgtcagctctatagcatgcaactggctgccctttgggaaatgtggctcaacatattggatgtgccaatccatgtagcctgcctagagtgggagcccctgtaggaatcagactcagcactgggccttacttacttgggtgatgagaaaacggttttccttggggaacagggatggaggtaggaagggatcgccatctatagttagctgtaaccaagatgcacgcaacttctggcatggctattcctgtagtttgaatgaccacaggctagagtaagtcacccttgttataatttgtaccatctgtcttctcagctttttctgcctgacgtctgagggtcccacccactggttcagccctgctcccagttccttcttgtgccagtagcaccaaaccgggccttgctctctgccactatcttcattcagtttctccttgagcaccacaatgaggatagcattgctacccatgctcactttacagaggttaaacttgtccagtcataatgtcagccaataattgttaagtatgtatcctgtgccaggtgcagcacatacgcttttcatcaggaattagctcctttagctcagcaggtgatgagatagaaaaaagaaaaagagggagaaacttgtatagctttactccacaaaaagacattcattcaacaaatctttgtttattaagtccccaccacgtgccaggtaaagttggcaatgctagggagatagcagtggagatacagaccaaatgccctgtcctcattgcgcttacgttctagttaggagagagagattgtgaaagtaagaagcagaatatgagttatattagatggtggtcagtgccaagaaagacaaacccaggaaagggagagtcaggaggagggagggtttgcagttagtctgcatgaacagagaaaggctctaaaagaccaagacatttgagccgagactgaaagaggagagagagaaatgagcaaagagctgagatgagagccctgggggtgggtttatggatctgcaaagagcagaataggctagacagagccaggaaggagggtggggctgaagtcagagggccagtcttagctggagggaaaggagggtagcctttattctgaggaaggggaaagccactgagagctttgagccgaggcgcagtgacatttgacgtcatttttaacgcatctctggggctgccttatcagggtgaacatagtgtcagaaaggtattgagaagagacattatgggaaacacctaatttacactttcgtccactcccaaagatggctgagctccatctgccaggcttctctggagctcaagagagacagcagtcttataaataaaatcagatataagaccctgagcaggcaggggctgcccctcctcccctcctggcacccactcaggctcccagtgagcgcacacctggggtgtgtccataatgcttttgattatctttgttctcccagcctcctccacgtttgtggagttttctatttgcatacctttccctgagcttttaatgattatttccccatcttaaccgtttgccccattatttaaatgagtcttaggtacatgcagaaatgccaggtgggtgagcgtgctgaataggtgctataaggacggcggggcggagtgaggagtcacgggcctgccagttggccctgtccaccggtatggctgtgttcccatgcgcttcacagctttttttttgtcctccatgtgcaagccccacaacccttcttcaggtacatggatgcatggggactttaatgagaacattaaaccagtggccacaactgtctacatgacctttgattggagactattttgtagaggtactgggctttttttttttttttttttttccgctttgtcttagaaacgtcttagtgaaatatctggatttcactctcctctcttgtttccaaatttgtcctctgccagagttgtttgttttgttttaaattcacatagatcacacagttctcaagtgcctgccatgggactgggtactttttgtcactgcgttgagtccacacaatacttctagaggtactaagtttatctctatgtatcagatgaaggaaactgaaatgcaagaagcaaagggaattaacagcatttacaaagcgaataagtgaagaatgggggattcaaaccttggtctagcctgttcccaagcccatagtgtattttgtgcctcctccttttggagagtggggtagcaaaagggcggtatgtagaggagggggccagggctaaaccctgagttttacaacttgatcagcaatgagacaaaggaagcaggaagagggttgtctgcaggaacagacagcccttgtctgctattgtcgtcactggcttggaaaagatgtggcagcagctttatgaagtttccatagacagccagggatggtgatatgctgaatgacagaagcaggatctcaaagatttgagtggacaggaatgatgagttgaatctaacacaataatatttaataatagtaaatgtaagatctggcccttgggtgcaaaatattaaccaaccaatggaatcttggcttagctggatttatatccagcaaatatttactgagcatctgttctttgccaggcattgaggttgtagcagttaacaaaccaggcaggattcttgttttgtggggatgatactcacctgggcagagagaagcaaaagcaaataaacaaaaatagctaataaaccaccagagctgatgcatgctgggatggttggggaacaaacaggactgttcagttaggaccaaaagtcctggggagcttctgtagccacgaagctcaatgcatgttagtggcttccttcaaaagggggatgagagctctcagcaatttgtctgatagttttggaagaggttgttgttcaatctttcattgaatatgtatttattgtgcacttagtatgtggcaggcactattctaggttccgggcatagattgtcctcttggagtttatattctaatatgagagagaaacaataaactcttaagtaaatttataatgtgattttgggaggtaagtgctatgaagaaatattaattaggataaagagctagaaagcaatggggcttctttagggaacttggtcagggaggggctcgctggagacataatatttgagtagagacctgaatgaggagatggaacaattataagatatatggggaataatatgttggcaacaagtgcaaagactcttgggtagaaaatgggttagaggtccagagccattggcactggagtgaaatgagcaagacagagttcggaaaagtttgggaaggaagcagggtagacgctgtggagcaaatgggtgtggaaagaaatgtgaatttcaccataagtaagaaggaaagccactggaagttttttgagcagggcagtgctgcggtctaattggagtttcaaaaggcttactctgctgctgtgtgaagcatatgctcttggcgcaagaagaccagttaagaggtagtggagaaaggggcctggactaagtggcagccccaagtggacaaaggggcttagactacgcggtaaccccatagcaacaatccaaaagtcccccctggagtctcaagtggcctaagcgaagcctcactggtgacaggaggcaccagatcaggctccttgacacccccagggctaggggtcatgattccagcacaacctccttggccgagagagatttcaggggcttggtcctagtgacatgttggtctcagcctgtgtagtgctgattatttacagtactgcttgcctcacagatagttttacaggcaaacatattcaaagcaggctttcctcctatgtgttttctgcttagttaccttcgttttgcccatccactagtatcatagagcattcccccagctcccaagctcagaatgaaggtatctgctgacagatccctaaaagacaagccaaatatgtccagcaatccccaaaggggacacacaggatccacacatgtacagtctcatgctgctttcctggcagcaccctggtcatatccttgccacatactgagatcctgttttctctgctgaaaaatcaaggtctgcctcgaagcctgcttctgctccatggcaaacgacaagagcttcaccttctctgcaccctccacaagtccctgctggtctcgccattgttcaccactcagagagaggaggtgaccctttcctcttaccctctgtctcaccccctttgcttctgactgtgcctcctccacccccaccatctcttacacagggacacagctgattgctgtgtccaaggaggagacaggcatcattccagctttttctgtcacatgactctcggctgggtgctttcctccttcattcaggagactaacagccccgtgcacatcaattcatgagaaaaaatgccgagggactgattgcattgctgggtctctatgtccaatgtttacttggtttcctgtgaaaccccccagcttggtgtctctctttgatgtcattcatttggacttaagctcaggccgtgcaggattattgattatgtctttataggtccctaactagactacaaacagctagaagtcaggatctacatcttatccatctttgtatcccctggagagcgtagcgtggtgacttatttatggtgggtgtcctgtatgtatatgctgacggactgactgtttcactggccccaggggctaaagggcttccatgagggtctaagcagggaccgtgtatttgtctctgcttattcggttgtaacaatagatcaaggcaagacttcaattatcctttactttcattcccaaactctcttctctgttcgttgtattgaaaatgcctagtgacagacagccagaggctgaaagagacagaatgctttcagaatcttagcaaagctgtgtggcaggaaggacatatttcaatgaagttattttcctccaaggctaatattgtgcttccatacttcaagctctagtgagctcatcaacaatgtttgcctttaattttaccatttgtacccagtcatatgttacttgctgtgtttctgtgtagcttcgtttcatcaaagggatgttagggcttccattgtctttgaaaagttgcttcaagatggatgtgcatggatatccatcctgtttcattatcttctttgtcacattctctcagtcatctgtgaaagaatacgttgctcatagactcattaaaaaaaaataaaattcttgtggttaaatggaggaaggacattgcatattggtttggggcatggggaaccttcttgatttctccccacaggaaggacccctggcctttccctagaagagcatgtggcttcgagtcttagacacagctggggaacccatgggattgtagctttccagagaggagaacctatgttctctcagaaaggattccttccttcttttgtgaaaggctgtccattctgcaatgtgtattggaatcaccttgggataactgttgatgccccacccatccctggccaataaaataccagcttcctggttggagcttgaagcctgccattgacgtagttataaaagccccccaggtcagtctactgtgcagccagaggagaaactactgtgctaggccagtggctctcaactgggggcaatttttccttgagcaggtatttggtaatcaatgtctgggagacatgtttgatggtcataactgttgaggggtgtggtgctaccagcattgagtgggtggaggccaaggcagaagccagcccctcctaacaaagaatgatccaatacaaaatgtcaaagtgccaaggttcagaacctctctctagagcattagaaaagcaagcacacacatacactcaggtgcatacatagatatttttacaagtatattacctcctatttgcataatgccttctagttctcaaagactttttacacacttcatcggtttgatctttaccatgacaccgtaatggaaatattatcaccatcttgattttacagatcaggaaaccaaggctgaggaaagggaatgacttcctcaggaccgcaagatgttcagtttctcagtgagggctctttccattcgcagacaggtccaatgggtgcacatgcgttttcctgctccgtgcccctttgtgacaaacataataactgaacactgtctttgttcccgctgagcccaagtgcagcctcagaatccttctcaacacagcactccagccaaccccaggtgtgagatgaaacttgtcacatagcctctccaccctaaacaccatacccttccctgaattatgatgatcttgttgaaagagacaccaaggagagttcttgagagtaggagggctcttgaacatctgcaggtgttcagacaatctgtttgggaaattgcaacgttaacagcatgcgctcttgccggcacctatgaggaagcatctgtctccctaacccctatatttctttataactttattagtgtgtttggctctcaccatatgctgctaattgacatacaaaggaagtatgcacagttgtgttcctcatttggtgcagactaaaaacttcaccttcttcttgagcttgctaggatctccctcttgagcccaaaacatgagataattatgagaacatgaactatgattcatgaagccgatgggacaggaatgagagcacgctcagcctgtagcgtgaagaagctagggccagcagcccctgcttgagctctgggcacgacgaatagtggcatgtacaattaaatgcccagtgcctgtaagaaagctgccatgggagggaggcaagcagaaggagaaaaatcaagtgcagttagagactaacttctccatcttccaggcaggcaggtaatagagaagatacaggcagctcggtggatcatttggctccatcattgggagacaagtacaaaacagcatagagcatctgctcatcgaggtgtgggttgccgtttcaaaaagttgcaggagcctcttcgtaataaacggggctctagcctcctggtctggctttatcatctgcaagtatctgtgggatcagtctctagcagcaaacgtggagatttcattacaattgatgaatttgaccggaaatgatctccttgtgtctttggtcctcactatggggctggctggcgtgtgtgtccaaagacactgtagtgtgaggctgcacagctgttctgctgttctgagcccccatcatactggggagcgggagggatcaaggcatgctctgccactaattaggctatagcgacagtgcacaggcagcattcaggcgggtcttggcaacaggacaattcatagctttcctttcaccaggaacttggccagagacttcccatgttgccctagagttctggtgtccaccctggctgcactttggggactagctggggagtcctgtccacctctgtctacctttctatctatcactgctgggctagtatctcccaagggcaggggacttcagtctgttttgtttatagctgcatccagagtgtccattgtgcctgatactccatgaatgaattattacctcctctgtgccaggccttgccataccctgtcaaagatatcactgaccatgatgactatggcatctgtctactgtgctgtcattgttcttatttttatggatgagaaaactaaagctaagaagtaattaatttgtaggatattatacaatttgttaagtgggaaagctgtaatttgtactaagtcaagctcatatcaaagcccaatctctctggattcttgtgcttctgttcttaagaggagtgggtgtgaagtgtgaataactgcacacctcccttaattatggtagaacagttatttaagcaaactaagtggtttggaaaatgcaaaaagcttcatggtttggtattcgggaaaacagcattttctaagccatgctctgggaacaataacctcagaattgctaaatggtgtcccatgaaaaacacctaacatagggttctgccaataaacaacttggagaactacatcttctgacaccctctctttgtggaatcataatttcacattaatacaacaaaggctctgagcaatcctgcactgaataattctttgtttaatgtaaaatttgccaaatctatgtatcttcaaaacctctcttctttcctcattgacaatctattaatagctcataagatgctgctgttgcatttatagtttcttgatctggacatggcctggcatgtactagtatgtcaggcttgtaaaaatagaaagctcaataaaatataaacacactcatgttagcaaagcagatgctctaatgacaactctgaccttgataagttggaattgatccaacacttaaaaacggagctaacaaaaacttagaaattgaactaatatagaattttcactaaagacatgaagagcattgaaaactctaattcatttgaagctaaataatgctggcattcatcttgcaaaagcagccatgtattccacaacaaatttttgagcactgttcggagccagagactgttgggtattggaaatacaagtttaaatgaagtaggtttgatattgaccatcatagggttggcaggtttgtgtcttgtttcttaggcgcttcccatggctgctgaggaaatagctattatcctgcctctgtttgtctccagtttgtatctctgctttgtcttcatccagccctgagtttatttatccatttatttattcattcaagaaatcttcgttgagcacctactatgtaccaagcatggtagatacagcagtgaatggtacagataaaaattcctcccctagagaagcttcttcctagtggagcttatattctgattattctaggtttgtttcaagggtttcatctccccgagatcacatgtgacacatccttaaatggaagcctgggagcttctcacttgttcagcatttagatctcaataactgatccaaaccttcctggtatgacgttccattatgtccttgggccctgtccttgatccctgctatattatttactctgcattccctggccctttaggcttaactctgccttccaaccctgaataattccttggtttggtcctaaaaacttgatggagatcccaggcttgtgctccaggcattgtgcaggactacaaagatgagtaggacaggaacacgggttttcaaggagcacagcatgtcatgagggtgagagatgcacgaatgatacaatgaacttggtgagggaagtgaggaaagaggcagctcagacttcccaagggagggctcaccttatctgaatcttgtgggatggagaagatgtggtgaaggacaggtgggccgttgagagggaggtgaaagaccgtacagtttggaggagaagcaagaacagatgctggaagataagatgggaatgagcaggaagcagggggtaagatcatggtttcattgttcctttctgttcaacaatatgtgtgggctgccgctgtctcccaagccctgagctcaaccccaggacaaggctagtgaatagaacagacccagctctttccggtcaatgatggggacaggcaagaagcaagctgcaaacctcagctttgtgatgagtgctcagagacatatgagcactcatcacagtagaggagcaaaaatggcagctagggtcctgcgtggacagtcaggaaaggcccctctgccaaggtgacctagagctgaggcctgaaggttgagaaggagctggctctggggagaacagggaaaggagccagccaggtggagtgctgagcagggagggactgaggaagttatttcagggactccagaaggaatgtgcccagagcgtggaggaaaaagcaggggtttgggggtgggggcggaaggagcaggtggtattacattttgcctctgtgtagagagtgggtatggttgtgaaggagagaagatggggtacacctggaggaatctgatcatacttgcattttcaaaatataataataataattgcacagtgatgacattaagataattagtgtgtgtgttacaatgcataatgtaacattaagataattttagtgtgaaaatgggaaggtggttaaacaaaagtctttatcagttagcgctctatgcagagctctttacaggggaaaggatctaagatttactttaaaatagtttggaaaaataagtgcgggaagagataaaacaacattggcaaaatgatgttgattgctgaagctgggtttggggtacatgagggtcattaaatgattctatattttggatgtttgaaatttttcataacaaaagtgttttaagatttgtaaaaaaattatatgcagtaaatgcccaataaataggaaattgttaataacagttgctgtttattgagaagctactgcatggcagatttcgagttaattagtatattatatacataagcttaggtgtccctacacttttaaaattgtacacccatctacaaaagtgatttgaagcatatgccactgatagaattacatttgattagccacttacacaatgtcaaacggtgtgttttgagtatcttatgaagcatacacaatttttaagcaatttttaaaggaagaaattaagttacaataaacaatatttgatgtgttgctaattgtggtggccatgtactatcattagatggtatctccaggtacaagttagacatagagaaaaaattttgattaataagaatgggtataaatccatattccaaaccattttatgataatttcctttgaatgggtggtgggcagtgttttgtcagcatggatcatatcatcatttattttgccttttaaggtggtgcatgaagaaaccaaacagaagtggaagaagggtgagttccatcatttttcggctgctcacttatatttatctattagtactttaataaatagattcttagcaagaatgtcttttaagtcataaaacttggtattataacccttaaacttacccaggcacatataaattgccatacgaggcaattcactaaaaacgagtgaatgaatgagggggtgtcagcagctactttgcattgtaaaataaagaaaaaagttgacatacagatcaaatataagcctgggcacagtggctcatgcctggaatcccagcgctttgggaggctgaggtgggcagatcccttgagctcaggagtttgagaccagcctgggcaacatgacaaaaccctgtctctataaaaaatacaaaatttaactaggtgtggtgatacatgcctgtagtcccagctacttaggggactggggtaggaggatcacttgagccagggagatagaggctgcagtgagccatgattgcatcactgcaatcaagcctgggtgacagagtgagaccctatgtcaaaaaaaaaaaaaaaaaaaaagtgggtggcaagtgtctgtatatacataaatattatgaaagcttaattttctttggagacaaatcaattacaagtagaaattctaattctttctgtaccgcagtggagcatcacgagccccaccttggagtgtgtgcgctccactttggagagctttttattgatttctgagtactcttggtaaccctgtaaggcggacattttgcacataagaaaaatgagcccgggtaggttaaatgatttgccctaggggcatggttgttaagaagcagatcaggattggaactcagggatgacagactgaaagttccttacttattaataatagtgctaactgccagtccttagtattggctatagacgggacagtcatgtgggtaccatgatctctgtgacatagaagacagaaagtcggcaaggcaaagtaacttttttatgctcatactggtctgtctgaccctagagtccaactgtctgcacgtgaaccctaattcaccactaaactagagtacatgatttaccttccccagttctcagttttctcatctttaaaatgggccaataagaacacctaactcatagagcttttgcaagttctaaatgagaccatgaatgtgaatgtgaatagtatctataattattattgttctctattctggaggtaagagtgtggaagaagcttaaatgccaaagcatcagaagtactctaaaatatcaatgtatattattgggatgaaggaatgagttgcccgataggctcctccattttctcaaacaggctctatgcctggactctggtcttgcatttcacccacggtgaagctgcccgaggcctcatgctctcttgggcagaagcctggcaatttcccttgcctggtttgaatcttgtccaactatatctgcagtaggctataaccctaccattttcctcctggcactaggaataaaaattgggctcatcaatttttactattgaatcaggaaacctggagagaaaaaggccagcgtggacagggctcccatatttatgtggcagggacacaaataatgtcttgccgtctgacagcagatataggcctggaatttctgcaaaggctttccaactcacaacatattttaatgccatatttgagctctatggcagaaaggctctctctggacactggagcacagctgtgaaaaaaaaaattgatctactcctaagatttaagtatgctgcaaattaaaaaagaaattttcaggtggttcacgtaaagggaggaccatctgtcaagaggacccagagtcacagcaatgcccaaagtggacctgtgagaagactatgatttaccgggcatttacaacaggcctctctctgtgccaaacgtttctatctattatctcattgaaagcttgtaacagccatatgaggttggtactgataccactcagaatcctacatggaaacagatgatacagtaaaattatgataactagaggagggttactttgaaagggtactatgttttacaaaaaagaaatggttggcttaggggtggtaacagctctgttgctaccttctttacaaaggaaaagaatggggatttggaaatggagctcttggaaattctgtgggagttggcatgtcagcattttagggcacttagtcacattctgtatccagggtgcacagtagcccatgttgcagacctcccagaaggaggccatcaggactttgggcatcttggaagcagcctttcaaaaccattaatgctgctaagggagggcaagaagggtggagcctgggtggatcagatctctattcattgtgggtccaggtggtcactgcatctcagggtttcagcattggggtggaccgttagttgctgtccagaacatcacgttttcactttttaccttctttacaaaggtagcaacagagatgttaccacccctaagccaaaaacatgaggagaggtagcagttgccagaacccagaaggagaagagcctgcctcgggtagagtaggggtctttgatgggggtacacaggcagcttaaggtaacaccttggagtgggagcagtgggaatcaatagcttaaccttcctctccttcctctgctgattcctgctaggcttacccactggctgaagtcaaccagaatccagagggcaagaaaacctgctggggtagtccagggtttatcaacctctgaactgttgacgtttaagattgaataattctttattgtagagaactatcctatgcattgcagcatgtttaacagcatccctagcccctacccatcagacactgaaaacctttgactccatgtctcacatccaggccacattgatgcaaggggtaggctcccaaagccttggtctgctctgctcttgtggctttgcagggtacattttttttttttttgcattttgtgatatgcaaaaatgtctctagatatttccaaatgtccatggggaggtgagtgggaactgtcctggatgggaaccactggtatggttcatgtaggttactctccctggaagagagcaggatgtcgatgtgtagagagtagatctggagaaaagaaccaagagagaacttacattattctcatttcattgccaaggaaactgaggctcaagcaaatcaattaacttcctcaaacacacacagattgtgaaggcagaagccagtttgcaaacctaggtctgtttgatctcaacaccagaacttataatcacaagcctcattccatattcacagattggaaatatcccagaggaaaagaatggggatttggaaatggagctcttggaaattctgtgggagttggcatgtctgcattttagggcacttactcacgttctgaatccagagtgcacaaaagcccatgttgcagacctctcagcaaaaggaggccatcagacacataggactttgggcatcttggaagcagcctttcaaaaccattattgcccctaagggacgagcaagaaggatgaagcttgcgtggatcagttctctattcattgtgggtctagggggccactgcatctcagagtttcaccacttgggtaggttgttagttgctgtctagaacatcacctttttacctttcactctctttcagtttccttccttccttccatctatctgtccttcctttctttcctcccttccttccttccttttctctctcaaccctttaaagtggtattatagtaagtatatttcaagaggtagaagccactcaaatacctgtgaacaggtgaataaacaaaacaataatggcaaatgcttatctaggagttactacatgccaaatatattaggccattctcacattgctataaagaacttcctgaaactgggtaatttataaagaaaaaatgtttaattggctcacagttctgcaggatgtataggtagcatagttggggagggctcaggaaactttcagtcatggcagaaggcaaaaggggaagcaggcatgtcttcacatggtagagcaggagggagagagtgaatggagaggtgctatacacttttaaataaccagatctcatcagaactcactcagtgtcatgaaaatagcaagggggaaatctgctcccatgatgtaatctcctcccaccctgcccctcctctaatattggggaatacaattcaacatgagatttgagcagggacacaaatccaaaccatatctttctacccccggcccctcccaagtctcatgtccttctcacattgcaaaatacaattatcccttctcaatagtctccagtcttaactcatttcagcattaactcaaaagtccaagtccaaagtttcatctgagacaaagtgagtcccttccacctatgagcctgtaaaataaaaaacaagttagttgattccaagttataatgggggtataggcattgggtaaatattccctttccaaaaaacagaaatcaaatgaaacaaaggggctacaggccccatgcaagtcagacacccagcagggcggtcattaaatcttaaaactccaaaacaatctcctttgactccatgtgtcacatccaggtcacactggcacaaggggtaggctcccaaggccttgggcagccctgctcctgtggctttgcagggtatagcttctgcggctgtcttcatagctggtgttgagtgcctgctgctttttccaagcacatagtgcaagctgtcagtggatctaccattctagggtctggaggatggtggccctcttctcacagctccactaggcagtgccccagtgggaactctgtgtggggcctccaaccccacgttttctctccagattgctccagtagaggatttccatgtctcctgcatggacattcccatgtcttctgcctggacatccaggtgtttccctacatcctctgaaatctaggtacaggctcctaagcctcaaatattgccccctgtgcacccacaggcttaataccacatggaagccaccaaaccttatggtttatactttctggagcagtggcttgagacgtatttgggacccttttagctacagctggagctggagtggctgcaacacagggagcagtgtcctgagattgtggagggcagcagatccccgagtttggcccaggaagccattctctcttcctaggcctccaggcctatgatgagaggggctgccatgaaggtgtctgaaatgtctttgaggcattttccctgttgtcttggctattgacatttggcttctctttacttatgcaaatttttgcagctagcttgaattcctcccccaaaaatgggtttttcttttctgctacatggccaggatgcaaattttctgagcttttatgctctgcttcccttttaaatataatttccagtttcaggtcatgtctttgctgaagtatatgactacacactgttagaagcagccaggccatatattgaacgtttttgctacttagaaatttcttctgccgggtaccctaaatcatctctttcaagttccaagttccccacgtctctagggcagcagcagaatgccaccaactctttactaatgcataacagaagtgacctttactccagttcccaataaatttctcatctccttctgagacaacctcagcctggacttcattgtccacatcactatcagcattttggttacgacaatttaaaggtctccaggaagttctgaatattctctctttttcctgttttcttctgagccctccaaactgtttcaacctctgcccattacccggttctaaagctatttccacattttcagttatctttatggcaatgctccacctcccagtaccaattttctgtattagtccattctcacattgctataagtaactacctgaggctggcaattgatttggtttgctgtgcccgcactgaaatctaatcttgaattgcagtttccataatccccatgtgtcatgggagggacccagtgggagtgtaactgaatcatggtggcagtttctcccatgctattctcatgatagtgagtgagttctcatgagatctgatggttttataaggggcttaccccttcgctcaattttcattcttttctctccttctacgttttgaaggatgcgtttgcttccccttctgccatgagcgtaagtttcctgaggtcttcccagccctgtggaactgtgagtcaattaaacctcttttcttttaatattataaattacttagtcttgggcatgtctttattagtaatgtgagaatggactaatatggtaaattggtattgcagagaatggggcactgctataaagatacttgaaaatgtggaagtggctttggaactgagtaacaggcagaggttggaaccatttcgagggctcagaagatgacaggaaaatgtgggaaatttgggaacttcctagagtcttggagggctcagaagacaggaatatgtgggaaagtttggaacttcctagagacttgttgaatggctttggccaaaatgcttatagtgatacggacaacgaagtccaggctgaggtggtctcagataaagataaagaacttgttgggaactggagtaaaggtcactcttgttatgcaaagagactggcagcattctgcccctgccttagagacctgtggaactttgaacttgagagagatgatttagggtacctggtggaagaaatttctaagcagcaaaccattcaagaggaagcagatcataaaaatttggaaagtttgcagactgaagatgcaatagaaaagaaaaccccattttctggggagaaattcaagcttgctgcagaaatttgcataagtaacaaggatccaaatattaatagccaagacgatggggaaaatgtccccagggtatgtcacagactctcacagcagcccctcacatcacagacccacaggcttaggagtgaaaaatggttctgtaggccaggcccagggcccccctgctctatgtagccttgggacatggtgccctgagtcctagctgtgttagctccagctgtggctgaaaggggcaacgtacatgtcaggccattgcttcagaaggtgcaagccccaagccttggtggtttagacgtggtgttaggcctgtgggtgcacagaagtcaagaactgaagtttgggaacctccacctagatttcagaagatgtatggcaatgcctggatgtacaggcagaagtctcctgcagaggcagagccgtcatggagaacctctgctagggcagtgtggaaaggagatgtagggttggggcccccacacagagtccccactggggcactgcctagtggagctgtgagaaaaaagccactgtcctccaggccccagaatggtagatccaccaacaacttgcactgcacacttggaaaagctgcagacaatgccagctgtgacagcagccaggaggggggctacaccctgcaaagcctcaggggcagaactgcccaaggccatgggagcccacctcttgcgtcagcgtgacctgtatatgagacatggactcaaaggagatcattttggaacttcaaggtttaaggactcccgtattgaattttagacttacctggggtctgtagcccctttgttttggccagtttctcccatttgggtgtatttacccaatgtctgtacctccattgtatctagtaagtaactaacttgcttctgattttacaggctcataagcagatgaggcttgccttgtcccaaatgagactttggacttggacttctgagttaatgatggaatgagttaagaatttaggggattgttggaaaggcatgattgtgttttgaaatgtgaggacatcagatttgggaggagccaagggcagaatgatatggtttggctgtgttcccacccaaatctcatcttgaattgtaattcccataatccctacatgtcatgggagagacccagtgggcatgtaattcaatcatgggggcaatttctcctatgctattcatgggatagtgagtaagttctcatgagatctggtggttttataaagggcttcccccttcatttgattcttcttcttctctctcctgtcaccttgtggaaaaggatgtgtttgcttccccttctgccatgattgtaagtttcctgaggcctccctagtcctgtggaactgagtcgattaaacctctttcctttataaattacctcatctcaagtatgtccttattaggaacctgagaacagactaatacagtaatttataaagaaaagaggtttaatttgctcacagtactgcaggctgtagaggtgcatggctagggaggcctcaggaaactttcaattatggtggaaggcaaattgggaagcaggcatgtcttcacatggttgagcaggagagagagaaagtgaaggtgaaggtgctacatacgtttaatcaaccagatgtcatgcgaacttaatatcacaagaatagcaagggggcaatctgcctccatgaaccaatgacctgccaccaggcccctcttctgcaaatctacatgagatttgggtggagacacaaagccaacccatatcactaggtgccatgctaagtgccctacatcaaataactcatataatataaaacaaaacaaaaaaatccccaataggctctaataatccaattttacaaatgaggtgatagaagttcatagagattaagtgacttttccaagtccatacagctggtgagtgagggaccctaaatttgaacctaggctgttggctccagggtctgtccttttattacaaaactagagcacttcccacacaaatgaatatttttattttcttcaatcaagtacttgaatatgacatagaaatatgtacttgcttttatcagagtaattaagaaagaataagctagacaaatgtgcataagtcaaataactccaaaaataacgaagcagattatgttgaaagttcaggcaggacaggtcagcactgatggtcatgtgtaaatgaccaagtagaaggagatgttccaaaatgattaattagccaaaagtcctcgagactcacactaagtacacagacccaattgctcatctactaggagatgaaacctctggaaagctgtacagattataataaaatttgaatagaaatttgtggatttttaataatgctagcctaccagagcaataaattaaaatgacagcataagcggcaaagaggtgtaataccggcccaacaagatgttcaaagcacacagtttgtcgtgagatcccaaagctgccaagaagaaaacctatgtgaaaagttgtacctaggaagttgtatcataagggtgtattgtttggggtttactcagcctaatggccaggcttgcattaccttaggggatttttaacctcagctggtctgagaagttattcttatactttgggtatgcttatgatacatgcaatcaaggaaactgtcaaaatattataatgaaaactctaggaagtaatacaaactgcattgcaataactctagataactaaaagttcgttcaagtatacatataatgaaacaatgaatgaaatgctattttagaaccggttttagtgtgttttagtacatttgcaagcattatttgtatgttttgtctgctcttgaaggtgcctaaaattttcaaaagactcagatgtagcgtgcatagcagctcctgctggtgctgatgttctagccttgtgccttcacatccctatttttgtgcattccagttgactccctgaggctgaactgcatctttgtccgtgggccacccacaggcttccaggacacacccacatatgagcacagggtgggctggaagtgccctggaattgactgccctcgttaccaacccgggacagcagccctacccaatgactcacaggtgtaggggtatagaaaccccacctcccttgccttcttggccaggataattctgaggcatggctttccatctgttcctcacaggactgtcagtcacctactggcttgataacagatcccgtaggggctgactctctttcctcaaattgattgcccattcctttgccgatggccctacaacttccaaatatattttatattctcaaactcctatcagagaatgcttctggagaaaccccagctaagagattatatttgtatccgtggcataattagtatttaagggttgatagtaaaatttgtaagcaacatttaaattatcaagaaaatattgtctttaaaaaattgcatatgatctaacagataattttattaactggaacgctaagcaaagcacaggaattcacagttgtttgtcaccaggcacaaacatttcttatacactggataatacattaatgtctgatagtcaaactcctaatccacttcctaaaaacagcccaaatattagggtttcatggacccctagtgaattagctgtttcatcctctctattctcgcaacatttgattagtatttctgaaacagcttgcaccatgctgcactgtaatttatcggtttacataggtgtgtgtgtttcctagactatttcctgagttcctgaaaagtacagatcaagtctcatttgcctttgtcatttccacaccacattctggacttgccacattattggctgtaatattgatttgctgggaaaagaaaaagaataaatgaatgaaataaaaggcaccagtcctgtccaatagaccatattatgtgtcctcaaggactaaggctgttttatgtatcatcaaaatcactccagcactatgcagagatcatactaaacaattaaggcttagtgttgaaaactaagtgactgagtgaatgaataaatgaattagtgaatgaataattagtgaagcatattgccaacaccaggttgtttttgagcaattattgctaaatccaacttactctttacttttttggtagaatgtagcttagcttggttgtgataatgttttgttaatcaaataacaatataagttaatttagactaatagttttggctcctcagcatgattttaaaacttgactttgtcatccatcatactggatatttcttctagctttgtatcagtcataaacgtagccaatcttccctcatatcactgtaatggagacttttgccggctcagtccatggcttacttaggggtacaatcagccatgtaggccaggaattggaaaaccatggcctatgagtcaaatcaggcctgcagcttgtttttgtaaataaagttttattggaacacagccacatttatgtggtacatactgtctgtggctgctttcacacctcattgtgtgaaattctataatgacagaatcgagtcatagttgtgacagagaccatatggcctgtaaagtttaaaatatttactatctggtcctttacagaaaaattttgctgatgcttgtattagtctgttctcacactgctataaagaactacctgaaactgggtaatttacgaagaaaagaagtttaattgactcatacatagttctacaggctatacaggaagcatggctgaggaggcctcaggaaatgtacaattgtggcaggaggcaaaggggaattaaaattcaacatgagatttgggtggggtcacagacccaaaccatatcaatccttgatttagatgataaatctaacagtgaactacatgccaccgtcttgtgcataaggcctcccctgagccttgttatgtgccctgttgaaatcaagatacattgtgctcttacctctgtcattgaagtaacattatcaaggaggcaagtgcaattttatagtacaaatgcctctagtgaacccaacggatttctagtgatcaatacattaggaaacaaaatgttcactgaacatatatgtgatccttgttttgggaattctatccctgtgatagtgagcctggggttaaccattctgtgctggaaaagacttggaaaaaatgaggagtgaacctctttttcacttctctagcattcttctctatcccattcccacaaatggagaccctttggtgctagattaagctaatggttggctttatctccctggatcacagttttgtcatctataagatattagttttcagagttaatatgaggatcagatgagataattagtcgctgtaaaaataactataattaccaacatttagtgaatgctttttgcagacactgtgccaagaaattttaactttcattatctcatttaattctcataaaacatagtgaaaattgcccccagtttacaggcaacatacagatatattcatttgtcccttaagcaagtattcattttatttattattcattttttaactcacaaacaaaaattgtatatattcatggtgtacaacataatgttttgaaatatgtatacattgttgaatagctaaatcaagtgaattaacatatgaattacgtcacatatttattttggtgagaatgcttaaaatctatttgctgatttttaaatatacaatgcgttgttatatgatagatctcttgaattcttgaatgtattcctcttgtctaactgaaattttgtatgtttttaccaacgtctctgcagtccattaccccctcacccccagcccctggtaaccactcttctattctctgcttctattaattcagcttttttagattccacataccagtgagatcatgtagcctctgtctttttgtacctggtttaattcacttagcataatgtcctgcaggtccatccatgttgttacaaatggcagggtttctttcttttttaaggccgaatagtattccattgtgtatatataccacattgtctttatccacttatccattgatggacatgtagattggttttatagcttggctgttgtgaacaatgctgcaatgaacatggaagtgcagatagatcttcgacattctggtttcatttgctttcgatgtatacccattagtgcactgctggatcatatggtagttctatttttattttttttaggaaaccccatactgtgttctataaatggctttatttatattcccaccaacagagtttcacttttttccatattcttgccaacacttagctttcatctttttggtagtaaccaatctaacaggtgtgaggtgatatctcactgtggttttactttgcatttccatgataattagtgatattgagcttttttttcatacatgtgttggtcattttatgtcttcttttgagaaatgtctatccaacatagtagtggaagtcctagccagggtaattaggcaagaaaaagaaataaaaagcagctaaatcagaaagaaagaacttaaattatttatgtttagagatgacattatcttatatatagaagactcctaaagactccacaaataaaactgttggaggtaatataaaaattcagcaaagtggcatgatacaatatcaacaaaaaaatcagtactatttctatacattaacaatgagctgtctaaaaaagaaagcaagaaaacactctcacaatagctacaaaaaataaaatacttagagataaatttaacaaggaggtaaaagatctctacactgaaaactataaaacactgatgcaagaaattggactagacacaaataaatggaaagatatcttgtgttcacggactgaactaatttatattgttaaaatgtccatactacctaaactgatctcctgattcagtgcaatctctattaaaattccaatgactcttttcacagaagtagaaaaaaaattctaaaatttatatggaatcacaaaagatcctgaagagccaaagaaattttgaagcatcacattacctgaccttaaaatatactacaaagctatagtaatgaaaacagcatggtactggcatgaaaacatacacacatagaccaatggaacagaatagaaagtccagaaataaatctacacattaatggtcaattgattttttgacaaagatgccaagaacacatactagggaaaagacagtctcttcaataaaagttgttagaaaaagtggatatccagctgggtgcagtggctcatgcctgtaaccccagcaaattgggaggccaaggccggaggatcacctgaggttgggagtttgagaccagcctgaccaacatggagaaaaccccatctctactgaaaatacaaaattaactaggcatggtggtgcatgtttgtaatcccagctacttgggaggctgaggcaggagaatcacttgaacctgggaggtaaagtttgcggtgagctgagattgtgccattgcactctagcctgggtctcaaaaaaataaaaaaaaataaaaataaaagaaaaagaaaaactggatatcaaaaagaataaaattggacccttgccttacaccatataaaaaataatctcaacgtacattaaaaagttaatcttggccgggcgcggtggctcatgcctgtaatcccagcactttgggaggctaaggtgggtggatcacgaggtcaggagttcaagagcagcctggccaagatggtgaaacaccatctgtactaaaaaaccctgtctctagtaaaactactagaagaaaacatggagaaaaagctccatgatggtagtttgggcattagttcttttggatctaacccccataaaacacaggcagcaaaagcaaaaatagacaaatgggattacatcaaagtagaaacttctgcataaccaagaaaaagtcaacagagtgaagagatagcctatggaatgggagaaattatttgcaaatcatgcatctaataaaaggttaatatgcaaaatatataagaaattcaactcagtagcagaaaacaatcaattcaaagaaggggaaatctgagcaagtatttattaggcactactataagccaggtactatatcccaagtactattctagcacttgggatacatctttgaacaaaaccaacaaatgtccctaccctcatatatgtggagagtggaggcaaacaataaacaacacatacaataataacaaatgtatttaatatattagaagataattactgctatggaaaaatgaaagtagaacagggaaagggagactgaaagtgctggagataggttgggggagggaagaagtgatcagggttggcctcattgagaaggtgatgatatcaatgaaatcttgaaagaaacaaggaagtcagccccatagacatctgagagaagagccttccagtgtcactagctttggttgtggcacaaccaggattccaagtcagctctgtcagactgcagaacccaaactcacaataaccaaggtcaacaaatgttagttccctgctcagtcctctccaagaaatgtgctgtgaattcctgttttttttttttttttttttttcccttggctgttgcctacattcattctgggcttgccttgcctcaagccattcctataggtcaacatggatgtcccatctttgtctctgatcacatgctctgcctttattatgggaccttttcagacctgatggcttctgagggccatggtgctgcctttctggcttcaattcttgtgttttccctggagtagtttgtgatttcatctcagcaatcctccttcagaatcttctggcccttctaagtcgtgtaactatttagcctaccaaacatcatgcccatactttctctgtgtagacagctgtacttttatcttctctgttgttgtttgctcaagaagccagagtcactttctgtcacttacaaccataggactctgataccacggttttaaaagaatctaatttcttaggaaagtagtttttttggttgttgtagctttccagtgctggtgttttttcttcccttattattaaaaatctcaggaaagtagagttacctttttatggcctactgcccctctgtcactactaacgcctttcttttcaaacccaggcttagtcctcagtcacaggttgctttattggttcatcggcaccaagaggttgaaacagtcttcaacgtagcaactctccagaccctctatttttagctgaattagattcctagcagatgtctggatagtagacgtctctcttaattaccataacttgtctgggtgccatttttgagatccccaaaatagagattgaaaatagaacccacctcatagggctgtagtgaagatcaaatgcaaaaagtgcatacaaggacagttatcacagtacttggccttggcatgtagtgaggatttctgcgcgtcagctattccagttagagggaggcactttatttgtgttggagagagagagacagactgtttcagctcagctccactactcatcagcttcgtgattctgagtgatcgctcatactccctaggctgtaaagctggagtgataatagcaatttgagtagtacatgtaataaaaagtataaaataatatgtataaaaatcctagaataataacaattttagtattaaatgagataaaaagcataaaaatgcataaaattatgtgaataaaaatgttgaaataatatcaactaagtattgagtccaataaaatgtacaaaacacaaaccctataataataaaagcaatttgagtattgaatgggatgagtataaaatgaatattaatgctatcaatcaaatattaagtaaaataatatgtgtaaagggctgagtatggtgtcagacactttgtataagcacttgaaaaatacactccaatgttattgttgttaatattattgacattgtattaccacacatctcctcactgttagaacgtgttgctgtcaaggttgtcctatgcgataaagctcctcttttgggagataccaagtgagcacttaataataacaattctgatcatgcaccattactctttaggcatatatttaccgtgttagattgtcttttcttcaacaatctcatgagctctcacatgaaagtggctccaaacagaaattggcagtcaaattgggattttacaaattttatctctaacaatatttttataccaaaaggctaaataggatcttttaggaatttgagagttctcaaagggactaattttctccaaagaactaggtcacataaagggagaaggggaatgagcattaccctccaagaagctatgtatataggaagacaaaaattagttctatctattagagcagattatttggtttagaattaagtgagagaaaaattatatacaagtgacaccataagagtatcctggagcctgtatggctagaggggagtagtttgctgagaaaatagttattcatcatcaccgggtcatggctgtgtgccattatctttcattgccctggagattcactctgctcccttcttgctgctcagtgccttggaggctacagactgcctcaccggggctcctgggccccctgcttctagttaggtggctaatggagaacgctagatggagcaaagagggtgagggtaccttgggctgactgtgtcctttgacttaatgtcacatgtccggtcgggagcaacttttctctatgatgctgtcttgctggaccatgagttttttgaatgaagctagactctaagctctgtgaggagacattcaccagtgtctactctgttcaccactgtaccccagcacagtgtctggcccaaaagaggtgcttgataaatatatttctatcaaaggaatacactggggatgcctcactaaattgcattctaagaagaaccaccacctaaacctgccttgtgcactagctataaaaagaagccacactctctctgagcaggagttcttagaaataaaggctcttaaaattcccatccacaagctgtgactgcatcatattagtgatttccactggattgtgcatgaggtcccagatgtttgaatcttttattttacagcatttgcttttctgtgaggttccaattaattgaattgggaaaagctgtaagccccgtgacagtggaactatctctttgacaaaaccacatgctgtaaagtcaaagattcttcaatatcctttttgtttaggtccataaggctgaatgactgacttgactgattttcttttttaatatgtttgctttagcagctagaaattttgatgtcacacatataaaggccacagggtcatttggggaaacccacttaggtggcatgtcttcctagagcatcataggataatctggaggagaatctgaagaattccttttgttacattctaggctatttcttcctgagatttgaagatgcattttctctctgtcattttctctcatcaaagcctcaataaatgttgtctttagcaacaaccgctcaattctactgttcttgtgcatactaactccccccacccctcacctctcaaacatcagtgatattgcatgacatagtgcattccctaccactgatagcctatttctttttttgtttgcttgcttttgttttcattttgtttttgagacagagtctcattctgttgcccaggctggagtgcggtggcatgatctcggctcactgcaacctccacctccagggctcaagtgattctcgtgcttcagcctccccaggagctaggattataggcgctcatcaccatgcctggctaatttttgtatttttagtggagatggggtttcaccatgtttgccagactggtctcgaactcctgaccttagatgatctgcccgcctcggcctcccgaagtgctgggattataggcgtgagctaccgcacctggtggtagcctgtttcaactcaccatatgtgaaagtctgcaattgcattttcctcacccatcagggtgatcagtattccacatcgttctaatcatgtgaatccttgttgtccatcagctggcaatgactcaacagtagactctcgtttatttttcccaggaccgcttctgtttgctaactgccctaattttggtttcccagaggtcaagtctgatcagggattgaagtacatgcaatttgttgagagaatgcccttaagaaataactgagggaaaaggggaatgaagatagggaagggaaatgctgagtaaagatgtaatcacaggtaaagtctagtcttggcctgatccatgggggtattcctgccttaatttgccccatgaagttgtctttgctacttgaagcaaggagattgccagtcatgaactgtgggctgcctctggtcaatggcgtttcctttggatgaaacagttcttgtcctcctagggcatatgatggaaatggagagcacctgtgagctgttagcagccagagttcatagcaacttcacttgactagtaaaggggcctgggtggggtgctcagagcatctgctacattaacttgtatgatctcataacaatcctatgaggaagaagtcattataattatcattttacagatgaggcaacatcttgggttgtgtgtctcagagacagatcctgagactagatttatgtggtttatttaaaaaaagtgttaccaatactttagaacttcttacagaaaattcaagcaggtgtaaatgaaatcctctctaacacattctatgagaatagcactaccttaataccaaaacaagataaagacattacaagaaaactacagacccagtatctctcatgaacaaaaaccctcaacagaatattaggaaataaaatataaaaatctataaaaaaaataccacaaccaagtagaatttattgtaagtatgcaaggctggttcaacattcaaaaatcaatcattgtaatccattatatcaatcggttaaagaagcaaaattatataatatcaactgatacacaaaaagcagttgacaaaattcaacacccatttataataaaaaattaagcaaactaggaatagaggggaacttgttcaactaataaaacatatatacaaattatttacagctgatatcatacttaatggtaagaaattggacattgtccttcaacagaataaggcaagaacgccgttgtttaccactcttattcagcattgtactgaaagttatagctactgcaataagacgagaaaatgaaataaaagatatgcatgttgaaagggaaaaataaagctctttattcacagatgatctgattgtctgaaaatcccaaagaatccacgaaaaagaaaaatcagtcatgggactaatcagtgactatagtaacgttgtgagatataagattcatttacaatagcattaaatttttttaaatgaagtgtttaaatgtaagtaaaataagtacaagctgtatacatggaaaactgtaaaacactgataaaagaaatcaaagaagatctaaatagattgagatatattgtgcgttcacagattggaagactatttttaaaatgtcagttcttcccaacataacatgtatattcaatgcaatctcaatcaaattcaagcaacatattttgtagacattgacaaagaattctaaagtttattaggaaaggcaaaagacctagaataaccaatagaatactgaaaaagaaatcaacaattgccaggggtttgagggaaggagaaagggttgtgtaagtcaagtttgaaaggttttttacagtagtgaatctattctatatggtacattaatggttgatatatgacgctatgcattcattaaaattcataagtttatagtataaagaatgatctttggtgcacgcaaatggaaatatttaggaagttgtaagattccaagatgaaatgtagaatgtaacaaaagaatctaactgttttacaaatgtataaaccaactttactgaaggggctgagagaaaaaagagagaaaaagttgctgatctaagtaactttgaaacgagtggagtctgtaagattaagtatataagcactgtcccctagttgataaaattgtttcctataggagtatgggttaacaactctgaaatctctattcatagatagtgaaaatgtaaatcagtgacagatagcagaagccatcatttctcactgttggtgctggaggttatagacaagcaaggaaagatggctagaatgatttattagatagtgaattagagtcagagacattagggtgaacatacttggcttaatatatagatatgtgtatatatgtgtatacagagattagtgtatatacatacatgtacacatatgtatgcatacatatgtatgcaagtatgtacacatgtatgcatgtatgtacatatatatgtatgcatatacatacgtacatactgatatatattttttaaaaatatgttttggatgatcagttttgaggtatactgctccattatctggtagaatgcttctcaggtggggtttgataatccaatataacctgtcaatattgatctgtcacttgaggggtaatgacaccccagtagccatctaacacgcagatcttggcttctaatacaattttcaaataaaagtaactagggctccttgaagaaattgctgattctaggacttggatagcattacacaaatgagcttcacagcttcttgtgccagaaaataagaaagtgatggaaataaaaatgtaaaaactgcacaatgatggtggtatgttgaggggcacaggatccagctgaaagagttctcaatggccccagctagaacaatttgtgcaaaaactggtgtacattgtagtatagcctgaagtatatagtaaatatgtatgagtttatgttgatataaacaaatgattgaacaaattaataaataggagacaaatctcccatgcagaagaattccaaataatgtacatagatacttcacttgcaaggacgtggattataattccctactccctaggtgtgggctacaagtagtgacttccttaagaagagtacagtatggagagtggggaggagagtaactttagagagtgtatagtctttacatattgtaatgaaaatgacactttatttctgtggtcttcttttctcaattccacacctttagtttaattatgagaaacatattagacaaatctcaactgaggagcatcctaccggataatggaccagtatacctcaaaactggttatccctaatgaagaaagcctgggaaaatgtcatagcgaagaggagcctagggaggcttgataactaaatgtcatgtgggatcctggatggactcctgtagcaaaaaatgaacattaggtgaaaattaaggatatcagaataaagtatggcctttacttaataattatctatcaatattgagtccattattgtgacaaatgtatcctattaatgaaatatgtgaataatagagaaaactggatgtggagtatatggaaatcttgtagtatctttgcaaatttttctgtacataaaactactctaaaatgaaaactttattattatattaaaaaaaagagaaagtgtttcccgaggaaattggtatgggagtgaaagaaacagagtagggcaggacaacagggtgagattttgagtgaagacccagcctcagcctgaacctgtgcaggagctctggaggtaaattgcacagcagactttatcctgtccatagttgaggctgttggacattgatattcctgcacgagtcactgatcacagatgccgctggggtcataaactcctagactctgtttgtttgagcaaagtggctccagaagtccatgggtgatcttcagaagagaataaggtgaaagcatgctgaagtgggtgcaccatggacacacccaactgattaaggggattattcaaggaggtttaggcagcaccttcagtattcactaccctgagccacagagaaaataactcacttaccaacagtcacagcactggcaggtcacacagccagaattcacagctgggctacgtggcctagagctggcacccaacactacatggtagtatgctgtcctgaaggctctgcaactctcacaaggcttgcaactctcaatgacattgagaattacaattcatgatttcctgcactattgagggtctgggagataacagtggatatgcggattatgttctgacccaagaagttcccacagagaaatctctgaataccatgcaaatctaggagaaaagatattctgtaaatatgtattgaatgaatgcacatttttagcaaaaaattcagtggatcttaactaacggtgacaaactgggcactgacttttcaggctggggaagagagagaactgatggggcttagcagaatcatcatcaccatcagaaattgcctccagcaaaaaaagagtcctgtctgacaagctgtggccataaatgtctatttcccgcattgcccccaataccaaaggtccacatatgtcccattaaacaatttccaagtgacagatcccaggacaccaggctgccagaagaatcattgctaatgcaggttttataatctccactcatgtaacataattggattaaggctgtttcccaaggaaagaagcaaaatggtgcttagtgtggacaacttttctttacaagcaagctgtgtgataacagaacagagattaccattcctaaccacctgccaccatgaacctggaggatgcttattgtaaaaatgcctctttcctccaccagggtaaggcaaaaaagtcagtgctactgttagtggaatttatttatggctcaccttgctctgttgcttttggtttctcgcccctctgatttctgcttctgctgctgctttcttgctcttattttgtcaagaatccaaagtgttctgttagttaccatgtgttagtcagcctatacaacaggctgctgctgtaacaattaactctgacatctcagtggattaagtaaaacaaggcttatctcccacatgaagtgccttctcacatctttctagttatgttgtctggaacacatggtctgcaagagaggagaagggtgttaaggcacactaagtcttcattacctcagcctgagagatccacatgtcacttccactccgagttctttggccctatgtagttgcatggcccccacctgactgcaaaggagtattcagttctttggtgagtgtgccaaatttctagaagcttgagattacgtttttgttcctgatcgattgtgttttgaagataataaggaagtatgagatagaggctggtataataaagtcaactcataatttgtaaaaatgtgttgtccattataatagtagccatgtctggctatttcatcttaaatgtacatgtaaattacattttcagtttctcaattacattagccatatttctattgttcaacagcccatgtgcctagtgactatcatattggatagtgcaacatgggacatttccataagtacagagttttctcaagcattcgaaaatatttcagaacattctagaatgttctagagcaagtgactactatattatgactctaacagaggcttttaaggagtttatccaggcttctggcttaaggttttctttggtgaaaatcagcctgatgtgctttagtgattctgaagctgtgttaggaagagatccattctgattttaactggtttgcatgcttttatgtaagatttagctgaaacaatggacttcatgggtgagaaaaatttgaaaatcactagaggaatgtaaagaggctaagggggcataaacatctgaatttaaatccttttccttccacttatgagctatgagatcttggagaagttaactgatgagcagatccacagatttaccatctctagagactgagatggaatgtccacctcacagtgttgttacaaaggtgacaggatccaatgtgtgaatgaactgcgtggatccagtgctttttagtaacaactcaggaaatgatagatatcctcataatcatcactgtaattctacaacgctcatcaataatttagaagaaactaattgtgggtgacataaatctaagaatgataggaaacatgtaattcggcaaaaccagattcacaaagattataaaaaggataaaatattgtgcttagtttaagaagaggaagtttggtaagtataagcataacattttaccctggagtccaggaatgtaagtacataagaataaaattggagacaatgtagtctaatggcaccatattggaagatagtaatgtcactgttgttcaatcctgtaatacggctgtatcatgaaatatgaatgtcctcacctctttgccttagcaaaccatacatggatgaggctttaagtcttgttattttaggagaagccaagaaagctggagcagtttttcttctttcagaaaatatttaacatctcctatggtccaagatagtctatagtaccaaacatcaaaagattggccattactctctgagagcccacagactgcaggagagatatattgatcaaataaccacccaaataaatataaaattaaaaatgtgatatgtgccaggacagaaaggtccatggtgttcaaagaacctttactaggagaacttttttttctattcagggagaccaggggaactttcctttgaaactgaatattcagctcagacccaggtagaatagaggtgacttggcagaagaggaggagtttccaagtcacaaggaccacacttgtaaacatgaggtgagagagaatgagacgcattgagtgtagagggaaaggctcctgttgaaggagaacacatcttggaacataaggttcaggggaggcaggggccagaccacagggggccatgtaggctatgctatgatttggatctttattctagaagcaatggtaagcattgatgggatttgtataagaaagtagtatggtcctatttgccctttcacaagtttacaagactacaagataattacaagtatatctactgacatgatgcattgtatcgttgatttcctatggttaatccacccttgctctgaaagagtaaaccatatttggttataacaaatttttctttccttctttattcatgcatccatgtaacaaatactcattaagtgcctcctacatccccagcattctaggtgctaattcacccatgggcagataaggaccttgcccctgtggaacttccagtcagggagacagacaacaaatatgtgcaaataaatgtgaagcaaagcacagcgtattaagtaaacagggagcaaaagagaggctctatttcacatagtcagggaaggcatctccaaggaagtgacatttgcacgtagacatctgagtgatgggaggtagggcacccccaggaacaggcccagcttcttcgtccctctaggagctcctccattctcacagacacatactaattgaattttcacattttccgctctgttcttccctgcctccaaggagaaccttaattatgctattgaatatctggattcccattgagcttcagtagtgaactcagcattgtatctttctcatcctttccacctgtccttcactgcagctccctgacctggctctgcaaaacccatgctctgctcatttcttaaagaatacaattttgaaaggtgtgtttttctttgtccctatgcccgttatccttttaagtgtgttcattttgtcattcattcatttggtcattctcttattcatttgctcaacacgttattttgttagtgacccctttgctctgggtattgtattggtgtgatcgtactggtctttccttagagggtaagggatgtcttctcaagggactgggaagaacaccctacaggtgttgacttcttcgtctccaatgagatcttagtgatgtgtccatacacaaacacacttttcatgctcagcaggcaggtagctctactacagccctcctgcagtgaggaggaagcttcttccttcaacttggtttctcagactctttgcagtttttcattgtacaatgtgggcatgagaaaccacattgctaccaaaaggacctttcctcaggtagtgaagtatcttaaaatgaaacctaattatcatcacagcacatgccagtgttattttcttaaaatgaatggagataaggaagagcaattgatggggaaggagaaagggaccgccctgaccctagttctgggtatctcagaagggtgttcctggaggttggcttccatttctttcctgagaagtgcaggaataagggcatgaagtaaaatttaacagactgaggggctggtgtgttgcctacctttgtgtgtgttggagggcatttatgctgttatgaatgaaagggtagtacatatggtgtgtatttcaaaaattgtgcctttccatccatgcctttcatcagtgcagttagtaaaaatttccccaggatttttgtcattttttttttctgcaagggccagctgcagtctgttgtttgtatcttcaggattatttcataaaaatttgggaagaggcagtcacagcaggcccaggtgtgttgtctctatgttcacccagaagtgtccgtaaaggaaaaaactctaacagagttcttaaaatggaatatgctgtctccatgagatcatatttcccatctacgaaggtggtcaggcatgagctgggtcatcatttggctgtgtgctgaagtagtgattccagatgtcttgagtcaggcataataagttggttttaccttgtgtgcccagcctgatggattgttcctggctgtttgggctcagtaggatgaatgtcatgatccattaacaaggtctgtcctggatatggagagtggggaggatgggggcacacacaccatgtatttgtcatccctaggaagggaactgaactagagaattgcaatgcactgtgaacaatgagagtaccaagatgagtggtctctgtatcttcatctaaatacttcatgggaacgtgattagcgatattagcccgagcagtgcttcaggaaggtccagaaattaggtgtagtaggagctccaaaatagactattttagaggtgggaggattgtaagttcacattggtgatatctctagaaagtcgatcacctaggaagtctgtttctttcattggtgccacttgcttgtcattgagtttgttggtttgttggttgattaatgtgtattttcatcatttattgagcatttactatgtgccatgttctgtgctagattttcaagatagagatggatcaaatgatgaacaactcctaactttatgccttccagagtaattgggccacttgaaggtatctgccttggaccttaattgatttcgcttgtctaacatttagccttcttccttttcttttctggaaaaaagcccctatatttatttcaggaaatttctaccattttatgaagctcttgtagacagcagaatgcacacactgtccaccctttactcccacccactacaggagtgggcacagggtccaagctaggccggtcacaggacaaaggctgtgtccaaagggattggccattatggtgacggtgtggtcctggtttctgtacttctctcaagtcccctttagctcagtgagttaccagtttcctccaactaaacccccttgattttctaagcatggcctgacttggcttctgtgactagcaacctcaaaaccctgattggttccacacctttaggttggtgttaaggttaaaactctcgggccacagtcagattttcataatctggaggctgtttaacctctgacatagccatctacttcctaacccacaacttttgtcaaaacaagttgaggagctggctagtggaggaagacagattacagcagggtttaagtatccttgcctttcctaacttctgaagcacagatgtaacaacactgaattcacttcaccttccattcctgctagtggttaaggaggtgatgttttcttctcacgttacggaaaagatatctttggggaggtatagcacagagtttgcaagcatggactttggcatctgaagttggcttagattccagttctgccacttatgagttggtaactaggggcaaggcacttgacctctttgggtatcagttttctcagttataaaatggagataataaacagtccctactcagacagagttgtagataaataagataatgcatgcaaggcatttagccccatgaagttggactgcagtgatctatttaacgtggatttgtgtgtgtgtgttctttagatcctaaaaacttgaagttccactcaagagtcagttttaccctgtagccttttttaagatgcttgttaatatttgaatttgagaacaagagagactgaaggtgaaaacgataatcctatgaccttccccacccaaacgccacacacaagcctattctaaacccgtctttcttccttaagtgtgccaattacttcagagtgtattaatagtgccctctgctgcccagagcaccgcagcttaatgggatctcctggggcagatgagctgggatgtaggtctgagcttttggtgcttccatctctgcctgtcaccctcagacatattctccttccagttcacagctccattttctcgcctgcatttctagctaagctctgagtcatcgatctcaacctttaattcaagtttgtgcctggatctgaaccaaaccatagatagatactcataaaggttgtgcagatgagaatgtgtggttgttctgcttttgatcagcagcaggctgagattgcttccaggataacgggagccaagtctattttcttaggttacaatgaaggactcaagtcctgcctggagctggctgagtgatgaactaaattggagaaatgtgccatgtggctcgccgtgttgattagttgagttcacttgagtcccctttttgcagccaagtgcattcgtaacttccatagcatggtactataaatctgctgactatttctgtggtggttactattccagtttgaagagaggggtgtggagaaacagtagtgaaagcaggagtaaagacttctgacagattgaggctccacttcaaaccatctcatttagacctcatacttttagtgtcattataataactcctctagcaagactgcaacatggagaagttggtgatgaaatgataagtacccagaaaatccttgtacaccatgcctgcagagttcaggctagactcagggagatggtgagataattctttgtcttctgcaatggactgtgtgctttgtgcatcctggcaagtggttgggatggatttgccccgagccagtcacactctctttgcttccattgtgaccactgtcagttaggtaggtgcctaggatggtataatatgagtctccttagtcaaaagtcgaattaatttttaccacatcagaactggagatcttggcatcccaaagtcatatataccaaacacctgagctaaccatccaagttaaaaagaaatgccaaatccatgatactgtacatacttttcattcccataatgttatgtttacttccacatagctacacgatatattataacacagtaggtatgaacatgagctctggaatcagacaaactggatttgaatcccaggtttgaatcagttgccttcccttgcttcctcttgatattcttattgccatagcaggaatactctgtctatccaacagagttattataagaattcaagctgtggccagggacagtggctcatgcctgtaattccagcactttgggaggctgagtcaggtggatcacttgaggtcaggagttcgagaccagcctagccaacgtagtgaaaccccatctctgctaaaaaaatacagacattagccaggtatagtggtgcatgcctatagtcccagtcatcgcagctacttgggaggctaagatgggagaatcgcttgaacccgggaggtggagggtgcagtttgaaccaagatcatgccactgcactccaacctgggcaacagagtgagactctgtctcaataataataataataataataataaaagttggtaacgcacacaggcactttgcacaggtaatgcacacaggtcctttacacgatgcctggcagaaacaatgttagctgctatatgtgatgctgtcctggtagaaaggagctagttcacccatttcagaaaaggaaataagcaatgagtccggagagcagagctgagtcactctcctctactgctgcccctcaaaaagttgttcacctgtacattacttgttagtcttcaagaatttccacatctcatgtcattatgcaagtatccaatcagtatttcccagacatggagattttttagctctatatatgtctacattgcagatcagttttaaggattaaatacaatattgtgtgtgggcacttacacatatataactctggagaacttaaatagaattgtcaacttatgccaattaaggacattcaaagacaaacaccacaccaccatctactctctccactatttcatagaagaatctaaaattacatgcagtgttgtggatttttcatttctttttaacatgagtggttagctcaggtgtttgagatacatgcttccgggatgccaggatcctcagttctatgtgaaagaagataattagatttttttcacttaagggacacaggctgtgccatccgggtacctacctaactgacattggttgcaatgataatagcatatcaagagtgtgtgactggaacaccagaaaaagatcagcctgcatgctgaataaatttagctctatgtcagaactagaaatgttgtccatttgctgaggatggacaaaaatttgatctctaaccagatcttgagaattgttggtatagaccgtaggaaactgtcacctttcagaacaatccaaggctcccagcgacctcctctgagtgaataggataggagggtgaagacagacccctcagggctcctgttctgaagatcatcccagaccaacaagcttttcagagtgttcaaggatcagggagcatgtgtggtgggatagagatgcatgaacttgagccaagcaattcaaagtgatttgaagagaaatcccgaggcttatgtgtccttcactgtggtgagtaagcaagtggcgcgctgtccctggagaccagcaccgatcagtcattgcacaccctgaagtgtgctgaggatctctcagacttgccaaggctgacatgagtctggtcttaagtggaaaggacataccagcctctgggaagaggtgagctctggcagagaacggtgagggaggtgggggtcagctgcatctctaaccttctgtttctttagagggcgagagagataggtggcttccaaacagaaaggcctgtgcacatcagcgtgacagcagccggctggagagatggggtgcagcctgccagattcaaaggggtggctctcccacccccctttgaatataattatcattccacttggagatctagaaggaataaaactaggcccttgatccactgtctaatggattgtgtgactatcaagaaactgtggcagcctgtggaacgagacagacatgatctgactcctgaaagaaccacgtgtgagtcatgtagcctgggagggttcacttaattacataatgacctgtctccatcctcttcatctcttactgtcctgtccagcactgtccagcttctgacagtttcacccggggaaattttgtgcagtgtcttcagcattcagaagccatgaatattaaggaaggtatgactagttgaagatatcagtgaggagtgggaaagaaaacaaaaagaatgacaatagggccttactaataaggatcataattttaaaccagccgctatccacatgtggtgatggagctgctgaaatgaggccagtgtggctggtgtgtcctgagatgtgctgcaaatgtaaagtccccacttgattacaaacacttaggatgaaaaaaatgaatgtaacatatttcattaataatttcctgcatggattacgtcttgacatgttgaaataataatattttggatatattgggttagataaaattcatttttaaagttgatctcctctgtttgtttttattttcttttcatgtgaccattagaaaatttaagttgtatgtgcaacacacataattgcaagatgtttattattccattaggcagtgctggtctacagacttaggagtggtagaaggggataaggagaaaaggtcatgacaaggagaaccctactatttgccagacgctaggcccctgccctgtgagcctcttggcagcccaagttgggaactactgtatttattttactgttttaccggtgaagcttctggagaagaaactgtttgctcagagcccaacattgaataaatgctaagtgatgattcaaatttgggtgtttggactcagcagttcaatgtcttaactattaattattgcctttgccataattggagatgctcaataatgtatgccttgccaagtgattttgaggattaaatgcaatgttgtaggtgaacacttagcttaataagagcctcgtaagtaaggatggctgctattaatgtaaaaataataataatgaggaggagaaagtggaggagatggagaagaagaagaagtagggaggaaaagaaggggaggagtagaagtggggaggaggagaaagaggagacaagttattgccatcaccagcaatacgtgccaggtgctatcttgggcactttacgtacattatgtaatttaatgctcacagcaagcctagccaatactcacccgccctttctgcctctaattttttctggtatgagcgtagcaaagtccgcctgacacttgaatatttacttccacttcacgactcttcatcgtggtctgttgggtgcgtaggaagcttcagatggcaaagggaggtgctggcagggactggcagcaaatgagcaaactacagagatgagagggtgggacagagcctgcgttttgtaagggaagagtggctgccctaattttagcttctgattcacccaaggaaattttgagcagtgtccctagcatccagaaactgcgaatactaaggaaggtctgaccagcggctgaagatatcagtgaggagtgggaaagaaaacaagaagaacgacaatgataccttactaataaggatcataattttaaactaattaaatgccaattggaatggaaggtatttttctttaaggaattctagaaactgatttcatgcaattggccttgccccaaaaataagaggaaggaaagcatacgttaattagactaaataaagaatgaagctcatgtgggttgtggggtactttaaatcacacaaaagccttgagagatgtgaggaaggtggtgtgtgtctaccagggtcctggaaacttccaataatagaatttatatccgatcctggtcaagacacacaagggcacaaagttagtaagtaaaccatccctactactctatgccaccttttattaacccaaagcacagagcttctcactcatgaaagaccaagacagacttccccatcctccaaaggtggtggatagcaagggacaacgtttgcagtccgacttcttgccaggcccaggtctagctggatgtttgctatatgtccttgaatcttcatgctaaccctctgaagtatttatttttatccctcaatgtataggtgagattgaattattctgccaggtcatttaattacaagttggcagagtgcgaatcctaaattacgttgatctgactcccacatccttgctgattctaccacgtcatgtggccttctctttcaattccacagtcatgactagagctttctccacctacaccaattgcatgaagggggtctggctgctgggacctcccagggtacagagctgattcacttcaaccggcatccaggggcgtgccttggaaagccaggatggaggggtagtaggaaattgctcttttgttaaatgcaacttgggtttatttggaagcagaaaagaaaaagaaaaaaagaaaaaaaaaacgttctgaaaaagaatcatgagttgctccatgtaatctgtaaattgaaattagatggttgtcaataaattcttactatatatataaaattccatatatatgcatatatgtatttgcttatatagatatatagtttgggttaatttaataataatttaataatttaacttatataataataatttaatttattatatataatatatacaataatttaatatataacatataataataatttaatatgttaatttaataattactttaataataaatcattattaaatataaagtatctattatttagataaaacctaactatccttgtacacagcttctgtgatgtttaattttgagtgtcaacttgattggattgaaggatgcaaagtcttgttcctgggtgtgtctgtaagggtattggcaaaggagattaacatttgagtcagtggactgggaaaggcagacccactctcagtctgggtgggcaccatctaatcagccgcccgtgaggccagaataaaagcaggcagaagaacgtgtaaagactaggttggcttagtcttctgacctacatctttctcctgtgctggatgcttgctaccctcaaacgttggactccaagttctttagctttgggactcagactggcttctttgttcctcagtttgcagacggcctattgtaggacctcaccttgagatcgtgtgaggcaatacaccttaataaactcccctttatgtatacatttatcctgttagttctgtccctctagagaaccctgactcatacagcctctggaaagatttattgctgcctcttgccctttttaagaaataaaataattaattgatatggttatttaaattgttcaagaagtaagagaatacattctaatcatcaaacatctaaataattccccaaatgtgaaactctcctttcattcatgccctgctcccacctagccatctgctcttcccagaggtattcactgctatcagctcagtgtgaatatctgtagctttttgcttaccatttcatttataggaacatatagaaacatatggtttcttttttctatcaaaaatagggtcttatgctacatattgttctacaacttctctttttacataacgtggcttatttttcttggtggctgtatgctaccccagaggatggaggtgccagattcatttaaccatctgttattgacagacatttaggtggtttcttgtttttcagtattatgagggtaattctttagtctttcattctagggaatgcttgatattttacagtcaacatatggctgagtaaatatttaagattttatgttgacattttgctgtcaagtccggaacttttattatgcaattcaccttttggattttacgatagtatgtgttatcgctttctccgtcttagttggcaaggccacacctatcaatgttgactatcttttctagataacacaacttcagttttcatggctaagagcccgtaagcagtagtggccctgccttggctatgagagcaatgcttaaggatgcataaatcggagaaaatatgaaaatgacattttgggccgggcactgtagctcatgcctgtgatcccagcactctggaaggccaaggcaggcagatcacttgaggtaaggagctcaagaccagcctggccaacatggcaaaacaccatctctactaaaaataccaaagaaataactgggcatggtggcacatgcctgtaatcccagctacttgggaggctgaggcccaagaatcacttgaatctgggaggcagaggttgcagtgagctgtgattgtgccatggcactagcctgggccacacagtgagactccgtctcaaaagaaaagaaaagaagagaaaagtggcattttggagatttaagagttctactcctccctcttctcccctctaaactcttatccagttgaacacagacttgaagaaccaggggactgtcaagtgaaacatcagatgtattatattaatgagcaaggacagtgtccaatcctttcatatttagggtctcctattagctgtgctggagaacacagcttaggcctgaggtcaaagcgagtgtttttacaggtaacccttaaatctagactttgaacctatcttcagcaacttggttttcaggagttagtccaagcaagttcccagacagcagagggtctccagctacccagggagccatcatccgggggaggaatggtgttactctgaatgctcacccattcttggtcagcagcccaggggatgttgaaccttccctactcttcccaaacagattagcctgtgaccctcccatcagaatgagtgggtaagggggtacgcagaggaccagaagcacccagtcctgctctcttctagggaatgggatagaaatcccttcatggaaacatgcaagcaggagaattgggtcttcctcaacatagcacataatctggctttctagatattttccttaaaattaaggatttttccaaaaaatcaggctattaatttttgtgtactgtaatgagttacattgtgggcccccaaaagatagatgcatatcagtatctgaaccatgagaatggtatcttatttagaacaaggctttagcagatgcaattaaattaaaggtctcaaaatgagattaccctagattactctggtagatcctaaatcccgtgacaaatgtccttataaaagacagaagatacagaatacaatggcatgtgtggatggaggctgagcttggcgtgacactgccacgagctaaggaacgcttggagccagcggaagctggaagaggcaagaatggattcccttttagagcctccagagtgaacagagccctgctgacgtcttgatttcagacttcagggctccagaactgtaagagaataaatctctattgttttaagccacccagttttgggttactgctgtagcagccctatgaaacttacacgtttactgtaagaatgaaagaaggggctgggcacggtggctcatgcctgtaatcccagcactttgggaggccgaggcgggcggatcacgaggtcagaagatcgagaccatcctggctaacacggtgaaatcccgtctctactaaaagtacaaaaaattagccgggcatggtggtgggcacctgtagtcccagctactctggaggctgaggcaggagaatggcttgaacccaggaggtggagcttgcactgagctgagaccgtgccactgcactccagcctgggcagcagagcgagacttcgtctcaaaaaacaaaaaagaaagaaagaagaaaatggcattctagtccaaattagaaagacgagactatcgagattaggctgtttacctttgctctaaattcagctgtttcctatccctatttagagctgtagttattttccccccgttcataacccacttgtaattttctttcatccagccttcactggggcttcactggagcttatttatgaatcccgccgctgatggtttgctctggcttgtgccaggaggcagcaggcgccttgtgagtgatgatgatccagctctcttttgcttaccagctcttctagggcatctgatttttctttttgtcttttttaggttcaggggtgcacgtgcgggtttgttacataaggaaactagtgtcacggggggttgcttgcacagattattttgtcacccagatactaagcctactactcattcattatattttctgtttctctttctccttccaccttccacctcaggtagtccctagtgtgtgttggtgtgttgttcccctctttgtgtccaggtgttttcatcatttggctcccacttataagtgagaacctgcagtgtttggatttttgttcctgtgttagtttgctaaggataatggtctccagatccatcctgcaaaggacatgatctcattctttttacggctgcatagtattccgtggtgtatattccatggtgtatattccatggtgtatgtaccacttttctttatctagtctaccattgacgggcatttaggttgatttcatgtctttgctattgtgaatggtgctacaatgaacatacatgtgcatgtgtctttatgacagaatgatttatgttcctttgggtatatacccagtactgagattgctaggtcagatggtagttctgctttcagctctttgaggaactgccacaccgttttccacaatggctgaacaaatttacattccgaccaacagtaaataggtgttcccttttctccatgacctctctagcatttgttatttatttatttgagactgagtctcactgtgtcacccaggatggactgcagtggtgtgatctcggctcactgcaacctccacctcccatgttcaagcaattctcctggcttagcctcccaggtagctgggattacatgcacatgccaccacaccctgctgatttttgcatttttagtagaaacagggtttcaccctgttggccaggctggtcttgaactcctgacctcaagtgatccacctgcctcagcctcccaaagtgctgggattataggcgtgagccactatgcctggcctcatgttattttttcgctttttagtaatagtcattctaactagtgtgagatggtatctccttgtggattggatttacgtttctctaatgatcaacggtactgagctttttttcatatgcttgtcggccgtgtgtatgtcttcttttgaaaagtacctatctgtgtccttcgtctgctttttagtggggttctttctttctttcctttctttctttctttctttctttctttctttctttctttctttctttctttctttctttctctctctctctctctctctctctctctctctctttctttctctctctcttgtttgagacagagtctcgctctgtcgcccaggctggagtgcagtggtgcaatctcggctcactgcaagctctgcctcccgggttcatggcattctcccgcctcagcctcttgcgtagctgggtctacaggcactcgccaacacgcctggctaattttttgtatttttagtagagacgggtttcgccgtgttagccaggatggcctcgatctcctgacctcgtgatccacccgccttggcctcccaaagtgctgggattacaggtgtaggccaccaagcccggccctttttttcttataaatcaattgaagtttcttatggacgctggatattagacctttgtcagaggcatagttttcaaaacagcatggtactggtagagaaacagacacatagaccagcagaacagagtagagagcctaaaaacaagtctgcacacttacagccatctaatctttgacaaagttgacaaaaacaagtaatggggaaagaactccctattcaataaatggtgctgggataactggctagccatatgcaaaagattgaaactagacttcttccttacactgtatacgaaaaccaactcagaatgtattaaagacttaaatgtaaacccaaaactataaaatccctggaagacaatctggcaataccattttggacataggatctagcaaagatttcatgacgaagatgccaaaaccagttgcaacaaatgcaaaaatcaaccaatgggatctaattaaaccaaagagcttctgcacagcaaaagaatctatcagcagactaaacagacaacctgtagaatgggagaaaatatttgcacctggcttttctgcgtccttctttggctgccccttagtctaaatcctggctctgatttccatacatcttggttaaagcaaagtgagaagagataatgaaggctttctacttatgctggtagcctgagttctccacgacagtctccttctcttttttttctttaatttaaggctcatgggtacatgtgcagaaaacaaatactgcatgttctcacatataagtggaagctaaacaatgagaatacatggaaagtctcctcttattcaggagaaattgacttgggaaacttttaccacaatatgtcaatgaattcaattctcagttcacccacactggcccctctgtcattgtatcaaatagctttgctaagagtgagcattttcagcatctttatagccttctttggccctttcctaccaattggggcttttacaaaggagtcaagtcctccaccttcttggtgggaaatatattgaaccacaaattgaacaaaacagaataggtttaaaacagctgctcttctaatgttcagctcatcaaacttgcaccaggctactggtgatcttaacactactgggagagagattgctttgtgggagatcatcccacccagcggaggtgatgagtatgaatccctccgttggccttcaggatggccagcagggccagttttatgaatgtgccacctatatatgtgtgacctatatagtcacacagcgtttggtttaatgctctgctgttgctatcctgaatttcttaataatttatgaataagaagccccacagtttcattttgcactggggcccacaaatcaagtagttgctcctcgtagccatcatgggtctgggacactgaagtccctggagtggtcattttctgcagcaagctacctcctcagttacctggtacatcatggatgctttctttgttggttttccttttcaatagacactatggtcagaagacttcaggaagtaacactagaaattatgcatagaggtttgagaagccatttcccccttacctcccgcttggagatatttggcaatacttggagacatttttggttgtcacaactggaggtgctactggcatccagtgggttgagggcaggaatgctgctaaacatcctacgatactcaggacagcccctaacacagagaattatctggccccaaaggccaatagtgctaaggttgggaagccataagctagaggtattcaaaggtgatccttatacctgcagcctcagagacacctacaacctttttggaaatgcagaatcccaggctgcagtcaggcctccttgaatcataattggcattttgacaagattaacacaatccccaggtgtctcatgcacattaaagtttgagaagccctgtgctagaacaaaacttactttgcttgtgcttgagtgtctgcaacgttgctgatgggcctgccctggaatgggaaaggccaagtttggaacaaacaggacatatggtgtgaggaaggaaagcccaaaaagcgattatggaattatggcaagagaggaaaggtacagccacaaactagctgagtacagagcaacaggtctggaagacaaggcaggagaggacataagtggccagtcctgggaggagccaggggcacggaagacaggacggactgtgatgtgagggatgggatggggctagtggttctaaggagagcttgaatccccattgcatgtagcttgttttatggaaatgggtagcgaagcttataaaggaaacacactggtgaatacaggtattgaaaaccatcagaaaccactcagcgtctggactgtgatgtgggtgttataagagtctgcctgtgttcgtttgctagggctaccataacaaagtactgggtggcttaaacaacagaaatttatgttctcatggttctggaggccaggagtccaagatcaaagtgttggtagggttgatttcttcttaggcctctgtctttagcctgcagatagctggccactgctcctcatgtcatcgtgtgctcttcctctgtagatgtctgtgtccaaatttcctcttcttataaggagaggcagcagtcatactacagtcatactaaatttggacttgcacatatgacttaattttttgttgattacctctctcctgcccctatttccaaatgcagccacactctgaggtactggtggtgaggacatcagcatgtgaattttggggaaatagaattcattcctctgttttctgcccccaggcacccgtcaacatccagatcttccattcctctttactgggctcccctcagcaccaatcctggcccttttccctgtgaccttccccattgagacatgaggttcactagctcgtggggagcccagcatcctattaaatattaaacacataggctctgggctcttgaaagacaaagctgggttgtgagccaagtcctgctcttccctccagaaagcactttcttccctctctgggtacaccacacggaaggcccccaggttaaccagggcaattattagtaaacggttagagcacggttgtctaaatgttttgatggataggttgaagaagtatgaatgcaaatgaatttttaaaacacactgcagctattgttgggtataatggaatgtcattaagcacattagctgctgattttataatcaagtgctaacattttctggaaggtaacctaagtaacaggagatattggccatttgcaaaacatgtttaaacaaaaaagattcagagacaagaagtgcctctcatcttaattatttttttgcatcataaaaacctcacaaacaatgcttctgcaaacgcataatggatgtggagcagctgtagaaaacatctcacttcttttgttgggaaacgatgttttacatttgggaaaaaaaaattctgtccagctgattctcttccaaggagagggcgagtctgagagagaaatctctgctgtctgaggaatatctatctgtgtccatcaaacattggtaaaactgtcgtgggaatcgctgaaattgtgcttgttttgctgtagatgttgcttcttcaaggtcatgtctgggtagcagctgagtcttcaggggagggtgacttaagcatcacaccctgccattgatttctaaggagcatccttccttatgggtagagagagaacttctttttgttctgttctcttttcctgagcctctcacaggccgccagcatcagcccagacttgtttttctagatgcctaaaataatatggctgaccagtccgaacagtgggggcagaactaccacaacaactaagccaaccaccctcaggcaagtggcacatcctgccttttgaaggtcttagatgtgaacctgtggccagggaactctgtccagtgggccagcagtcagcaacctagccgtgggacacagtggcaaatgaactctggtgtattgttccccaattgcaccagagttcatttgcctgccttggttgacactgacaagtggccctggatgaactgaaaaaaagtgattaaccagcaagcatatctgagcaagagacatgggccatgagcggaagctctttggttatttgccttgaggtgaaagggttttcagccttcttggttcgcaaattcaatgtttttctttcatggagggagtatcaaccatggggaggattgataagtgttttgttcacttgctcaatgtctatttatccctcacaattttgcctagcttttcccttctttattaagtcttactttaaacagttataattaaccaaaccatacttctctgtgttggccccttcacaggacaatctgtctgtctttaccctgtatcaggtggctattgctgtatagcaaaccactcccaaatttagtggcttaagcaacaactgtttaccatttctcatgagtaactgacaaccggatagttccgttgatctggttgaggctccgatgatctgggctgggtacattaatatatctgtggtcagttagcagaactgcttggggcagttgtttaaggatggatgatctttattgggacacattagctttccctcatgtatttcttacctcctcctataggcaaacctgggcatggtctcacagctgtggcaccaggtccaagagagaaacagattgctcaggtactttatcgaatctctgatccagttggccaaggcacgccacaagaatcagtgtgaggacactaccaaaaaatcaggaaggcatggaaaagtaggatctttaatgtaatcaatatagacacaatcccccattctgtagactgtcccgttaccatattcagttaccttgtctaacttcgaactgaagtccagctggctgagcttgccctccctttccaggaggaatgagatcttaactcccgtgaccctcaccctgggcagagaactagcatgaagagggtcactagaccataggcacctcaggggaatggccaaaattgcactctggatatgtggcacattatagggacttaaacagtatgtgattcagtggaaaatgacagattctgcattcccaagatgcagcctagctaaactccattttaccatttctcaaaatctcccaccagaaaggccctggcgcctcactcagtatggatatttttccccaattacacttgagttcatttgcctgccttggttggcactggcatgcagccctgggtgaactgaaaaaaaacagttattaaccaatgaacatctgagcaagagatgtggcccaagagaagaagccctttggttcctttccttgaggtaaaagagttttcaggcttcttggtccacaaattcaatgttctcctttcaccgagggagtatcaaccctgggagggttgataagtgttttgttcacttgctggatgtctatttatccctcaaaattttgcctagcttttcccttctctattaaatcttactctaaacaattatagttagctaaaccccttgtatataacccactgcacctataaaattctattattctttcattttttttttcactacatgtgtactgaaggcttcctgtgcaccaggcactgttgaggggctgtatgaagagcagtgaacaaaagcaaagtccctgctctcacggagcttacacatggaagaaagaacttaataataaataaagaatcaaacaaataaatactatatgagctgcaaagaagaaaaataagattaggtgaggacaatgatggggtatgtgtttgtgtggtgtgtatgttcatatatggggtatttgtggggtatgtgtgcacatgcgtgtgtatatgtatgtgagtgtgtgtgtgtttgtgcatgtatggttggggattctatattagacagttggtcagggaagccctttccataagttgcatttaagcagagacctggattacatgaggaagtgtgagtattttgggagagcttcctagctacagcagatagagcaggactgacatgtttgaggcatggtgagaaaaccagttggagtttgactggataagggagcgagtccagggcatgcaatttgagaggtagaaggtctctgattatgttgggtcttataggccaagaaaacaacttaattttgtcctaagtgagataggaaatgtgatagatgaaataatggtccccatttaggtccccatatcctaatccccaaaacctgtgaatatgttatacggcaaaagggactttgaagatgtgattgagttaaggatcttgaaacgtccttaggcatagggtgatccctatgtcgtgggaaatttccttataagggagaggtgggagagtcagagtgagggagaagataggacaacagaagcggaggttggagtgatatggggccatgagccaaagaatgcaggcagcctccagaaggtgggaaaggaaaggaactgatcccccaactggagctcccaggaaggagccagacctcctgataccttggttttagctcagaagatgcatgtcaaacttctgacctccagagctgtaaaataatcagcttttgttgatttaagccactaaatctgtgactttttttttttttacaagaggaagtcactggaaagttttgaagataattatgatagagaccgactcacattaaaaaaacacacacataactgggtgactatggggagaataagaagaggaagaccaagtagaagagtttgtaaaagcccattgaagagttaatggtgcttggctggagtggtgatggtggagaaaagtgaatgaactctacatgtgttttgaaaatagactccataggactcagtatgtaagacattagttatcagggctcagaggggcatggatgactccagactcttgacttaatcgccttaaaggataaaaatgtcatttactgaaagtagggaagtttggaagaaaatcatatttggagatgtggtgtttgtatgtgggtggagagagtggattaagaattccatttggatatagtatgtttgaaatgtctataagtgatcaaaatggagatgtcaagtatcctgttgttttttgtgaatttggagctcaggggtgtgttctggctggaggtcgaactataagcgagccatggaaattgatgaaatcacctaggaaaggtatgtggattggggagagcacaggctggagaggggaagtggcagcattccacgtagatcttcccaacattaacaatactccttgtttggaacccaggctagagaagagttctagaatattggtgtgaagaataaacaactaaggagatttcagagttacccacttccctctgcaatgtagaatatgactggacccaaggtgatattccctagcacatattcataatagaaatatatgatgttttgtaaaatagatcataaataaaaccacatatttgagcaaggcagcaatcatattaacccgtgtactgtgataacctttgtctaaatatacccatgaaactgctttaatatggttcatcagataaataatgattgcaagaaaagggttaatacttgggggaagcagaaggaagtgtactatgtggagggcaagatggcttcccagattgattcatgtgctcttgttgactgtttccatgtcataaatctccaatgaagagccttgctgtttccaaattgagggcggggaaaccccaaacaagaatacaatggctcaccagggaaggcattaaccaacctaaatgctgctttccttccctgaagaaatctcctccatctgtgctagagtcgttatctctgccttccttggaaaggagaaaatttgcactctcaaaaacaggatttgtgtggccaacctgactttggagatataaaataaaatgataaactttccaaatgaagaacagaattagctctgagttctgactttgcttgtccggcaaatgaagacagagccatatgcaaaactgcctgctggaaggaaaacaagttccttggtacctgacccacagaactgatctgacaatagagaagagctcatgttcaaagacacggtccaaccttagggcttttaagaaactcacgatcattgccttgattatgtaagttgtcttctattacaaaatgaccatgctgctatattctcgccatatgcagaatgtatcagttagccttttccaccgtaatgctgtataacaagccatccccaaactcagcagaatataacaataagtatttcttgcttatacagctgtgaggtagctggtgttggatcagtggctctgttctacacattttcattactggggccacggtgaaggggcagcatttatctagggcagagggaaggccttcttatggtggaggttggaagcccttacaggggtgagtggaattacacaatgtttctcaggacctaggatcagaagtggtgtactgtcacttatatccagattccaatggcccaagcaagttacatggtcaagtctaatattgcgtgacagggaagtgcactgctcccataaagtttagggaaagagagtgaatatttattaaataataagctaatctgtatggggagtaacattaaatttctgttttttagatgtgcaaattgaaacacattgagatcaatgccatgtctgtataatagttcacagttgaaactcagagaaaacatactatattaacaatgaaattgttattcacaaggctatctgttgcatgtccatgtacttggtcatcaaatatagctattctcatgaaagagccagaatgactctcctatcattcagtgaatgcctggatgtcagtgaccacatagtgacctgttgaaagttgattaaaatgaccatcagataattggatgatagcttgtgactggattacatgacacagttttgaatcttttctctttccaaaaatcagtgaactgttcattaaaacccaagccttgttcttgggagaccataccatgaccatcttctggcttcaagctgtgacaatgtggcaaacataatctgttgttcaaggattgactcacattttcccagctaccaagatgactgagagtccagtgtcagtataatctcagtgagtctggtttggtcagcttgcccaaaataatgtggacttgcaatggtttgaatgtcccctccaaaattcacgttgaaacttaattaccattgtaacagtattaagaggttgggattttaagaggtgattagctcttgagggttctgccctcaccagtggattaatgctcttaccttggagtggcttagttatcacaggagtgatacaagttcctcccgtatcttgtcttgcatacttgcgtcggcccttctgccatgatatgaccctcaccagatgccactgcaatgctcttgaacttcccagcacccagaaccatgagccaaataaacttctattatttgcaaattatgcagtctgtggtcttcttttatagcaatggaaaaccaactaagactgggcatgtgtcacctcatggactcaaatgaaagaatatggtctcttgtatcaactagtttcttaaagcttggttttcggcactgggtccctctttttcttttcatcctcaagaaaaacagaggtcagcttctctcacttctctttgatgtcatgtctgtaattgctactctttcaggagaggacatgtcccacatttgtcctgccatgtgcatgggctcagaatccgaagggaggtcaaaaaaggaaaggatcaactaggggccacatgactctgataaattttaagatatggaggctcagtagtgcctgcccacaccgaatcccttactaacctggatgacaaggctccagcagtgggcctggcctcttgagaagtgatactctaattgtacatttctgttcatcaaatgtgtccatcaaactcacttcctttttctccaaatgctccctaagatatttcccagcctcccctgcagctcaatgaggtcatgtgactgagttctgaccaatggaatgagggctgatgggattcgctccattcccaggcctggctgatgcatacctcccacactctctcctcaacactctctccctttctaccagctcattgtcctaacgagcagggtggggctggggccatgggttaaagatgagccaagctgcctaccaaccgggaacacctggtcggttacacgagtaaaaaataacttatattttgttaagccactggaatttgggggttggtttgttcgagcagttagtgctatgctgattaaaagcacttaattatttttttagtctcataataaaactctctcaccttcccatgcctccagggcctttgcttggacatggtgatgatttgaggacccaaatatgtctttctcgtctttaaggctgaccagagtatccttatgagtgagccctatattctgtccatgataaggctgatgacagctaatagttatcaaagacttattatgtcctgcacgctttatgcatgtggattataccttgtgaacctcaaaaatccagtgatgtttattttgtctttttcactgtttaggaaatttgggttcagagtagccaagtaatatggccaaaatcatacagctagaaaactagggaagtcaggaatgaagcccaggttaccggactctggagtttgtgtgctaacgactgtgctgggttcctgttgatggttagtcctacctgtggcagaactttctccaggcagcctctcatgggtatctctggaaaccagtgcctactctcttgccatccagagtgactgagctctccatgcacagcctatccctagcccatccctgattctgacaaagtctgagcagaaggacactgtctgggctccaggcagctacaccattcatcttcacgctgcctctgtttggagacaggctttcacaagccagccttttcatttaaaaacctcagcctgcccttttgctcacccacactgggaggccatgtccacaggagcatttctcccattcagcctagtgacggtgagactgattacccattgccccgctttctagattgctgaagccaggagcagcaggaaaaaccaccttcaaggctactgcatcaaagcaatggactttgcggaacaacgatgaatgggccagaggggggcctgtgcgtactctcacagcataataaggtgcctgctggcagactccctccaagagagtcagagacactcccttgctacagtcaggcctcctctttttccttctggccaaggctgagctcttgtccctatcagtcaaccttgatgtcaatttccaggaaacagtcagaggcagctcagagaaccagtgaggcactgggaggtgacttggggtgagtacgtggggattggtagtgggtgtggagctgagcttggagccctgggcagtcccgagcagccacagcctgagcctagagctgaccctgcgatgtgggcagtgtgtggaacagcggtcagaagcgcaaccacttgcttggaatgtttgctccctcacttcctaattgcaagactatgaattcatttcctaatttctacacgactcagtttccttatgtgtataatggggcctttagaaataaaactactccccaaggatgtgacaggcagagaaggtgctttgcagaacagcagcttttatgatgcccttccaggccttacctcctaagcaagccttgtttggttcacaatgtttttcaagaaaatgtgagggctctggaggaaaataatagagaaccctgttgatatcccctgtggggtcatactttaaggcttcagaagggagaggccagattgatcctttgagcttctctaccttatttctctcagtgagagaagggcaagggaagggcaaaaaagtaaggttgctgtgtttttcccagtgaagtgggctgtcacctggccccttggacctcaatcctggtttgcctttgcttcctatctgcaggtggcacctcctgtctaagatgggaaaggcaggagagtgggttgctggagaaggaggtggcaaagagagaagactgaacaccaagacagtgaggagaccctcaggaccgctcggatgctgagaaggttggagggccagagcatgcaggggagccagcagaccccgcctctgctgtgaggagtctctctttcattgtgtggcactgagaaagccctggaccatgtggtctaatcccatggcgagtgtgtatttttcaaagtctagtacggtggcaattccagtctctcttcatgttcttaagcaactgaggggggttgtcttgatttggtttccccagaagccaaccccgagactaggatttgagtgcaaagaatttgtttgggaaataatcccaggaagctccagtagggaagtaggagagtgatgcagatgtggtaggctaaaaaatggcaccaaaagacgtctctgtcctaatctctgcaacctatgagtgttacattttattgcaaaatctttgcagatataataacattaggctcttaggttggggagatgatctggattatctgggagagccctaaatacaatcacatttacccttctaagaaggaggaaaagggagatgagacacaggagaaaagaagggcatgtgacgggagaggcagagattgcagtggtgtagaagcaaatcaagaaatccccacagctgccagagctggcaggattctcctctccagcctccagagggagcacagccctgctgacatcctgatctcagacttctggccaccagtactgcaaaggaatacatttctgttgcttaaagccatcacatttacgaggatttgttacagcagccacaggaaattaatacgacagggaaggtaaggaagttatcgagggtgtgttaataaaccagctacttctgtgggcaactgaggggctcctggagccctaagtactgcacttctggtggtctcacctgcagggcaagaaaactggagtttgcctgcaccgtatgtttcagtcaatgtttgatggctacttttgggggcatcaagtctctggctcctctggcctgctctgtgcacccaaggaatgagctctctgtgcctgagaatgccatcaggcagaatatctattgcagttttctgcagtaagaagctgccagcatgctctgaattggtgttaaggggtagcttctgttctgagggtccatggtcaatttgacggtcttttcttctggtgtctggatctctcacatggcctgtggtctcacactcctcctagccctgtctcacccagggcagccctgttcaatcatctttggcacctgaaagctctgtctgagttggggaaggagaaagttggtgaatccctacagatgattaattttgtttctattacaattatagtaaaaaagcaaaaggagaaagggatttccacaggattgtggaattgaatttctttcccaaatctgcccctccagtatatggagagaaacatcatctaggtgttccagtggcccaccatttccccctgccattgtgtctcttcagcacatttctctggatttcaagtctgtttgggcagtgcactgaggaccccaggaatattaactacctatgtagggtattttacagtttcccctcagttttgggaccagtgttttagttacttctggtgatgagagagtgaggatggtattgttagatgtgtttgaaccatagcaactccatcttgaatagggactaggtaaaataaggctgacacctgctgagctgcattcccagtaagttaagggattcttagtcacaggatgacataggaggttggtacaagatacaggttatagagacattgctgataaacaggatgcagtaaagaaagtggctaaaacccaccaaaaccaagatggcaacgagagtgacctctggttgtcttcactgctacactcccaccagcgccatgacagtttacgaatgccatggcaacatcaggaagttaccgtatatagtctaaaatggggaggcttgaataatccaccctttgtttagcataccatcaagaaagaaccataaaaatggacaaccagcagccctcggggcttctctgcgtatggagtagccgttcttttattccttaactttcctaataaacttgctttcactttactgtatggactcacctcgaattctttcttgaatgagattcaagaaccctctcttgggggtctagattgggacccatttctggtaccagtattataaaaatattaatcactaaccattactaaacattagtcattattaatcaaatctgttttacagcagggagaacagaagttgattgccttactactcaaagtatggtccgtggaccagaaacatcagcctcacctaggagcttgttaggaattcagaatctcaggccccactctggacctgctaaagtaaaacctgcatttcaccctgatttccaggctgttcattacacttggggaagcactgacttactcatcctaactgaaactctgttgagacctgggtcttctttgcagacatgaagagagggagtggaatgagcagaagtaggcaccttagcatcagaggtcctcttctatgggtgccctggggactgaggactcctccatcttcctactgctgcttcctctgtgttgttagaagagtcctttatactgctggacctggtgagtactctgcgattgtgtgttgagatgtgagaagttaccactccgtgtcatgggagcgggaaggacaaaaccacttcacaccttactgggggattatgaattcagggccacattcaggtggttgcttcctctggcaacctctccttagccctcttccccctggaccgggcctctgggggtgaggcggccgtgcttctgtctgcccagttctgaaaccctttctacccttttaggcccctcacctgggttgagtctgtcatattctgctccctaaagctaccaaggttccaacttatcccacgtctttccataagctcttttgaattttctcgctcctgtaacatctcggacaagaggcgcgttgttacgctaaagccagcttctcccatgagcctttcttacacaaataaaatagatgtttgcctttgttccttccacttcacttttttacactcccgggcacaggcttttaacagagtttattataaatggaaaagaaagccgctaggggctataaagggtgcccctgcattcttccaattccagctcctgcccttccctgctgcctgtgttttcaataatgagtgtcacagggggatggggagatgaatgaggactgataagagcaaaccattatctccctcagctcttgggagcaggcgaggggtgccaccacctgagcttctgcaccaagacaggcaaagcactttctctgtggtcctcctgtctcctccgcctccccatgaaggagtttctttggggggaagagcagcagactccagtcccaggacctgggttccttgtttggcctttgccaccaacatactgtgaggcagtgatcatgtgactgaagctttctgggcctcagtttccttctgggtagagaagcttgttcttcctgcttcacaaggttgcatgagtccatgtgttaagatattcttccttggataaagaaagaaatacatagttcccactgtcttcctgaaagtgcctgccattggttgtgattctgtcctgtggggctccagaggacaaggctaagctgccttacaccaatgatggtgagataatagatgtgcaagcacttggtaaactgtaaagtgctgtgcctgtgtgcagcattgtcgttgctgtgacccatgagtctgatggtccaccgtggggtactgagaaaaaaaagagggtgaaactaggaagcttccataggccaggggagaggctatggggaagggaatttcaagtgggataaaagctgggtaagaagggaagggaggatgcaatgattaaaaagaaagggtcagtgcattggacatgataatgggcatccttcatatattttgttttattttattttattttattttggagacagtgtcttgctctgttgttacccaggctggagtgcagtggcatgatctcggctcacttccacctccacctcccgggttcaagagattatcctgcctcagcctcctgagtagctgggattacaggtgcataccaccacacccagctaatttttttgtatttttagtagagatgaggttttgccatgttggccaggctggtctcaaactcctgggctgaagtgatccactcacctcggcctcccaaagtgctgagattacagatgtgagccactgtgcccagaccttcatatgttttaagtttggatttcaccccttcttccttacctctgaacttagggttgtccaagtccctcttgatatgataaaagatttaagctcaaggttccagtcgccttaactatttcagtcatcactaagatgatcaccttctttgaaaaacacactttgtacctgttgatatcgtctcgagttgcactggccatttctttttgccagctgtgttttatattgggctggcggagcttacagtcaactcatgcatcttttctcttatgagctggtaccaatttggctctcactatttttccattttgtatttaagataagggaagaaattttctgtaattaatattttttaataatgtaaaatgtcagtggcttaaacaggcatgatgaggctccagccaggtggacaatcccatatgggtttccaggaacttaagcggggattggtgaagtggtgaccggaagcagagaggggagggaagggccagagggctagtgtgggaggaccagcctccctaatggcccccagtgaacctggccccctactgttcatgcccttgtgtagtctgctcatgaagtaactcagagagactatcaagtatggccatgattacagcttgttaatctctcaggctttcataaaaggcatggcagcttctaccttggcctcttgggtctcttagtttgagggcatccggtgaccatgacctggggaacctcaagcagctttctggagaggcccaggtgaaggagaactggggtctcctgtagacagccagcaccaatttgccagccatgtgggcagctactctgaaagatcctcctaagacaaacattcaagtggctgccatcctggccaagtccttgccgctgatagacaccccccagtcaggaatgcccagctaagccactcctgaattcctgacccattgaaactctaaatgatagtaaacgtttattgttgttttaagctaccaagttttggggtagcgatagataactaacatagtgggtacaagctctgtgccggggagagctgagggtcaagttagagaagtcagtttttgcttttgctccatggagtaaaagtttttgcaggaaaaaaagcctttttattttatttttctaagaaaacgttgtagtttatgagaactgcttctcaggaaggagggaagtgttgaccactcaggggtctggagctactgcaccccttaacatatcaagtcacaggcttaagaatccatgaatacaacagaaagtcccagtgaacatggcctgtggttgtcaggggatgaaggggtcttgtgacattcggaagagaaagatgaagtattgtgatgtgcagtgggggagaggaaggtggtccttgccataaattagcaaacttcattcagacttttagaaaagcatacagaaaacatatctttgaaagaagttgcaatatttgttcagtaaaacgtataggatctccaaatgcgttgtagtgtttgtccaaggaagtaaagcactgaagatctataaagcagtcatggtgtggtttcagcagagtaaaatactctgactctctcattaattgagatttttgagttttgggatacgtgagatgaagttcaactgaccgtggattatcatcagcaggaggccagaaatgaaagccagaccataaggatcaggagcagggcagagccggagtggccagggccagggctcagagccaagtgaggatgcttgacagttgctgcaaacatggctgctcagatatttttagagggactgttaagagtctatgactgggataagcaactccctgctccagtctgggattctctggtcctattctcagaaacttgggcagtaacagggctctggtagtgcttgcctactcctgggatatataaaaaatctattgactgagtcaagttgaggccacagatatcaggatgcaagggattctggttctcgcagtgagggctccacaccttctgtacataggcaatctagtgtgggatttccagttttcctgggagaaggcaggtttttctgttttttttttttttttccctgtcctagtacatgtgcctgagtcgtccaaacgatacgggatgactggatgaaaggtgcccagctaggccaggcgtggtggctcacgcctgtaatcctagcactttgggaggctgaggcaggcggatcacttgaggtcaggaattcaagaccagcctggccaacatggtgaaaccctgtctctacaaaaaaaaaaaaaaaaaaaaaaattagctgggcatgatggagcatgcctgtaatcccagctactcgggaggctgaggtgggagaatcgcttgaacccaggggtagggtgcagaggttgcagtgaaccgagattgtgccattgcactccagcctgggtgacaaagagatactccatctcaaaaacaaaaacaaacaaacaaacaaaaaacaaaaagaaaagaaaggtccccatctaagctgatgacaattagaagtactattattttcaagacgttaagtcagcttacctttccagtaacctaggtctcttaatagtgttttcctttttctgattgaaaataaaatgcaaccaattgaaaaaataaataacgttagagaattgtgaaaaggcaataatgtcttcatccaggcactcaaaaatatgggtcatttttatgattctcatgggcacatgaaatacatacatgaagggtatggcctaaacaagactgatttggttgcaagaaccaaaatctgatttgaaacaaaccagcaagcaaaagccaaacaaataaccccccccaaaaaacaaaagaaggaagaaagaaaagggtgaaagaaagaaagaaagaaaagaaaaaaagaaaaaaaaagaaaaggaaaagaaaagaaaagaaaaaagaaaaaagaaaaggaaagaaagaaagaaaagaaagaaatttattggattttgctttggatgtttggcttagctgccatcttccattctccgtatttcttggttcagattctcaagagagagaattggattggccaagagcagttcaggatccttccaaggcaggcaggctaggacagagtggtggcagggccttctcctctgggttggaagggtcattattagatgggaggttcatgtactaggcagacactccaaaatgtctactacaaacctccacactggtggggagcactggccagcttataaccacacacacttcggtgggctataagaaatccaaagctttaaggttgtctgatttagcaaaaaagaaagttattataagtatttaatagttgtgacatatttaataccaggaaattgtttgttgtttatctgaaattcaaattcaactgcacatcctttattgtatctggcaacttgacccaagggtgagggttatccttcttcgttggagctgtcatggaaaaagaactgggaaaattttaactctgagtctcaaactaagtttttcatgcccaagggctgcttgtattcatgtcctgtttgttttctgtgatctgttttcattttcaagagaagcaacctggtttgatgagaaaacagagaccccgacactgaggtctgaatctgccacttgtggactgcatgatgctgagcaagccagtgaggtacctctgtcttctcatctggaaaccaggcatcgccatgcctatttcagaagggtcctgtgagctccatccctgttgttccaaatggtaacacttcctttgttcttcaggctgaatagtattccatcccatatatatatatatatatacacacacacacacacacacacacatacatatatatacacacatatacatatatacacatatgcatatatacatatacacacttatgcatacatacatacatactctacatacatggatgtatatacatcttctttatcatttcattcattaatgaagcacttagattgtttccattctttggctattctgaaaaatggcgcaatgaacgtaacaacacagataagtctttgagatactgaatttaatttctttggaaaaatatccaaaagtgctcagtgaaacaagcgagacagagagaggcaaatactgtatgatcttccttctatgtggaatgtacaatagtcaaactcatagaagcagagagtagaagggtggttgccagggggtgatggagggagagggatacagggaaatgttgctcaaggagcacagagtttcagctatgccggataaataagttttggagatctaatgtacagcgtggtgactgtagctaacaatagtgtttcacacttgaaatctgctaggagcagagagctcaaatgtgttgttcttagcacacacatacacacacaatgtaaccatgagagctgatgggtatgttaattgttgtaatcatggtgattatttcacaatgaatacatacatcaaatcatcaagttatgtaacttgaagatgtacaattaaaaaaattatttaaatattgttgtgaggaagaatacctagggggataccagccatgcggcaggttctcaactaatacatgtgttccttctccttgcttactcatcatacaaacagaaacaccagtatctattatcattattgagtagctatgatcatgtatatgccagctgtgggatcgtgtgctgttcaagcactgtctcattggattctggcaacaatcaagtgagagagctactatatccctctctaatttactgatgatgaaactggggcttaggatggtaaaagagtagtccagggacacaaagcttctaaacagcagaaccaggatgtaatcctggggccgggcgcctccagcgttcaagctgccagttctcagtacttttccttgtactcagaaagcagaaatcccattgtgtggcatgtggaacagttgcagtgttgaatctaccctctgttcaagtataattgggcctgcaaccacttattgactaatatttgttgagtatttacaccattgcaggctctcttctggacactgggaatgcactgatgagcagggaaagtctcttcatggaattccaatcccagttaggacacagacaataaacaaacagacacaagcaagaccgagcatcatattgcaatacgtgatataaagagaatgatatggaggaatgagagatgtgactgttggttagggagtcagaaagggatattttgaagaaggatgttcccggaacatttctctgaggaggtggcccgtgagccaagtcctaaagcaaacatggggagatgcagacggagggctgatggcaacaagaacaagccaggagtgatatgggctcagcgaagaggccggtgtgaagcagagtgtgcaaggcagagaggtaggagatgaggtcagaccacagcaaggaggtagagatttattccttggtgatggggagatacacagcgccaaccacagcttcagaagaaagccctcctgtctccaaggcgctgaagcctgcatgaggaaaccaatcatgccacttatcgccccagtttgaaaagtaattgcagacacatgtgaaaagggcagggcaatcttttctgccaattatgtgccctgttattaggcgattagaagctggtgaagtcacggtgtgagggattagccgcacaatctcctctcccaccgcctcctcatttctgctgcttctcctgagggcacactcttccttccccagggaatggtcccagcttgaacaggtgcctttccaaatgatgtcctctaaagcagcttgtccttgtttgtaaaagaaaaatgagaccggcaagagacccttaaaaaactgcagctgaaaagcaaggtgacaatattgcagactttcgaagggtcttgtcctgagtgttcccagagctgggaatccaccagattgtgttggtccttgacacacttccattcatatgcccctttcgtgttttattcagttcttatgcctgtgtacacctgcccatttctgtgggtcttttcttcactgatttatccagcttctcattctttaagccaatacttaacttagcacctattttctgcctggcacagagctattcttttaaattaatggtgaagtctagtggttaagagctttgggcccaaacagtcctgaattcaaatcccaactcagctccttcagttcttcctacatttagctgtgtcatctgtgtacatgtttaagtcatataacttaatggggacagtggagggatgggggtctctgtctctctaatgcccttcattcatcctcattctcagccctgatggataggagactttcagcctagcaccctaacacagggtagatgtcagtggtggcaagaggacgttggttggtgtgtagtgtcccactctggaggtgaagatccaagagcagggcggctctgcagggcgtggcctctgagggcaggacacgtgggcgtcgaggaactgcatgaagcaggaaggctgggaggaagaaagagaggcaaagggaaaagggagcagagacaagataaggggcttgccacaccatcaaagaggaatccctggggcctgaataaaagccagctaagccatcctgttcctgggcttctatggagcttggttggctaagggtgtaacctcaggaaccagattgcttggggtcaaatcctgattctgcctctgtgagctgtgtgagcttgggcaagggatcaaacctctctgtgcctcattgtctcctctatacaaagtgagcctaataatagaactgactttgtcggatggcttagaaggattccatgagttcatacacacaaaacgcttacagttacgcccaccgcagattaagcgttagcaattgtccaaatctaattgttctactcttctcctttcctgcccgcgtttcaccagaaaacttgctgtctgggatatttgttttgtttgctactatattccctgttctatttcctggaacagtgctcgaacccaactgatattttttaaagtttgtttgaatggatgaatacatgaaagaatatgtgaattactatcctgtgtactttgtgttcttgatcagctctgtgtgataatgggctccctgcccaacctttcagatattgtgggcatagtggcagtgtggcatgataatattaattgtaggtggggcatggtggctcattcttgtaatcccagcactttgggaggctgaggcaggaggatcacttgagcccaagggaccagcctgggtaacataaggagaccctgtctgtacaaaaaatacaaaaattagccgggcatggtggcatacacttattatcccaagtacttgggaggttgagatgggaggattgttcgagcccaagaggttgaggctgcagtcagccgagatcgcgccactgctctccagcctgggtgacagagcgagactctgtctcaaaaaaaaaaaaaaaaaaaaatggtagcacctgctttctgaggatagaggagcatgataccaggcccccgcctggcacaatgaaagtgctcagtcatgttacttgttagcgacatcattgctttgtgtggtataccccctctttcatgacacctgagtgctcaccaaggctttttgaccatggtgaagaatctgactatgattgatatgattgagagatgaaggatctcactaagactagataacctggattttccattccatgtggccaggctctaggcctgtaactctctggtcgtgacttcctggaatcagctagaattttgctatcttgtgattgtttaccactgttagtatacaccctgtcttagattccacagaattggcagagtctgaaatatttagaaacattgggtccagtgaacagtcccataaattgtgcaggtgtccagttctgccacccaggggctgattccaaatccttggtggccgttctcttctcctaagttatgaacttcttacgttgctagctaatacaggtacttgagttttggcacattccataaaacataaggattgaaagggatctgtagaatagccagttcaaccctgtcataatacaggctaatatgtgttttacatgaacaagccatgtagtttgtataacagtctatgaaatagaaataggcaccagccctttttattgaaggggcatctgagattcaggagttagcagttctacaaagctagagatatggcctgttcatctttctattgacagatgaagagaggcagtatggcaagctggtcaagtgtttgtgttctagagctgggagctctggattcgcaccccttttccactagcaattatgcctcagtttattcattttaaggtgagaatagtgatagaactggcctcttaagattttcataagtggtaaacaatctgacatgtaacaagtgcttaaaacagtggctgacacattaccaatgactgttagctattagttaattaaaatgataattattataattgataaaatacgatattttacataaataataaaataatataatagtaaattttaagataaaataatcaacccaattaattctcaattaacgtttgttattatttctgtagttactcccaccatgtggcacagtacttggcagatggcaagtgctcaacagtgatgagttaagtaactcacccaagtctggctctagtaagtgacagagtggaatttaaacctaggctgttggattccaaaggctgtgcttattagcaagaaaggaaaccaagtcttcagaaacagtgatctgttttcactgcagcaaaagtaagcctcagaaacatgtccaggatccaggcgctctgactcccaggtcaatgcttggtcctcaatgacgtaggttccttcaccccagggcaggtttgcctatcactggttattggtgaaaggagataatcgtatttcctatggggctggttatgattcaatgagaaaagcatgagtgtaaagtgcttggaaaagtgtctcacacttaataaatgtcacatctctcatgattacttttcatgcatgcatttattaatgcataggtgctattttgaagtgctgtgcgtgcttgccactgggcttattgaggacatagataagaatcagacttgtttcttcacctcaggcagctcatggtgcagtgaaggactccagtaaatgaacaataacatgttgtaagtgcatttaacccaggctgggtagatcaggggcaaattcctggaggaggtggcacttcctggatgagctatggtccactgtgtggacctaggcctgcagaggagaaaggtgatacagataattccaaggaagcagcaggtgcaaaggtcctgaggaaaatgaagtagcctcacctgaggtgggatgaatgggagaatgttctctgtggttggtacttgacctttgttgtgggagattaacatagaaaaacagctatataggatctttatgcatggcatcgaatgccaagttagggatttggactttaacctaagggcaatgagaggctactgaaggttgtacatagataccacaaagaccagggacaaacttgctgttattaactgctgagtaaaattatgcatggatcatagtagacatttgatatttattggttgaattaaaaattgccctggcaacaatgtggaaataagactgaggagtttggggagactggcaacctacaaaccaattatttagtttgattccagaaatgtacttcttttctttttccttttttttttttgttttactatatcttgctttttataaaaacaactgctgaatgaatgaatgaatgaagaaggtgttgtcatagtctactttctttgttaagagagagacagtttatgggcatccaaggcaatgttacctgagagtactgaagtaagtaagttctggaataaataaccatttaacccccaaagaatagtaactgggccatggacatcttctgggaatatgctgagacctgtctcttcacccagaagccctatgacaagcaacgagaattctttgtcttctctcttgacactctctgatcttcggagtctcctggggagaaaaagtgaatcaatagattcattacacgaacaaggacctggcactctgaaaaggctttagatgaattcctgacctgtcaagtaagagaaaatagtgttgaaaatactctaccatgtcttgttcaggtgtgccctggttcaactcagtatctccagattcaccttgggacagtggcgtcctcagtccacctaggccatgtcccacagcccacaggagattggtcttggcaaagagaataggttgtaatctacttggcttgcctgcagggcccctgggcccttggtcttatggtttatgtaatatgagccttataaatatgcatgcttactcctggccatatttttgcacagaggttccttggcagtgtcctgccatcatcaagcgttgggccacttggtatttctgatgagattaatgcgtttagagagtcactggtccatccactctcattggctgtaagaccatctgttcatttatttcttaagaaatagattaggccaggcacggtggtgcacgcctgtaattccatcactttgggaggctgaggcaggtggatcatctgaggtcaagagttcatgaccagcctgactaaaatggtgaaaccccatctctactaaatacaaaaaaaattagccgggcgtggtggcacatgccagtaatccaagctacttgggaggctgagacgggagaattcttgtacctgggtggtggaggttgcagtgagctgagatcgctccattgcactccagcctgggcaacaagagtgaaactccatctcaaagaacaaaaaaaggaatagattattaagtgcttgtcatgaagcaggtatggtcctaagtagtggagtccaataataaattaagagctatgtagttgccatcatggaactcatattctagtgagggaaacaaacataaaaagctaacaacaaataaaatggtgacaaatgataggaagtgacacgaaggaaacaaccaggacataagccaatgaagggtgactggagagggacagcacctcttctgaagaggtgacatcaaaacaaattctgggaggatgaaaatgacctagaagttgggaaaaggaacattccagatggagagactagaatgtgcgcaggggtggggaagagcttgacagatttgatagccaagagaagggcagagtgcagtgagcaagagggaagtggaaatggaatgaatttggagagggagacaggagagaactttgtaagacattgtgggccgtggtgagcttcccttttctgtcatgcgctaggagagaatttaatgagtcaacatactcactttcaacttttatgcattggaaacaggaccagcggagaccatttctatgtccatttggagtgttgggactgaatggggatgcaaaagaggactgcactttgagaaccactgctctgggagatggatgctgaggtacaagagatgtactgttggatattttgttttgctgcagtaaatgtaagtattcgaaacagcagacttgcagggctaaggaagaactctacgatgcacctgcactctcttagtgatgcatcccactcctgtctattaaatatctgctcagtgccaggcaatgtgcaggcaatgagtatccgagagagagggacagacatcatccccgacctaatggaaaatgcacgcccgtcattttaaatccacagaagctcagattcaaaaaacaacagagtcttagatttgccttttctgggtctcatttggttaaattctgacagctgtcacacaatcagaatcattaaaatctagttttctgtgcttaacttgcttccaccgattaactttccccaacttattatagtggtcctgaccttggtctattcataaaagaccatagcaaccactaaccggatgggttgctttttataggagcagcacagttttatctactagaggcattggcagatttggattacattgtaaataaatttatccaatgcaaacattcaccaatctgcattgcattgtaaatacattttcccaagtgattgttaagtgatggccttacaatcatgttggcataagaaaaacaaccagagagagattcagtagctttgtagtaagtgttgatgaaggaaatgggatttgtaaggtgacagtcagcttggattagatggatggaaggagagggccatttggtgagtcaaggaatcatcaaggaattgaatttgtgatagacattaagtgttggccatacctatgtaaatatctatgttagatgttaagtattcagctttttgcccgttccctgagctacacatagtcccaagaaggggtattatttatatacaagtcatctatttctggataaaacaaccacagcaatctctgtgtcatatggcagtaaagatttattccaatggattggctgaggttttgctggtctgatctaggctggggcagtcagatctcactgcaggtctgagatagaatggagtgtctcagcttcacatggttctcactttcttggaccagcaagacatacaggaaatgttcctttcatggaaatggcagtggcataagagaacaaagggctcttaagacatatgcttagaagtgcacactgccacccccatctcatttgattcaccagtgcaagccaaacggacaagcccaaggtcaaagtggagtatattcactccacctttgatgaagcaagaattagatccaggtagaggtgaagaattagggctcaaagcaaatctaccatattcataagtaagttttcattcatctattattgcataggctcatgttatatgccagacactgtgtggggcagcaggagagatgtccatgtcatattcctataccactcactagttaggaacctgataaaaagagttctttctcgcattatcttctatatgttgtgtacgacagtctgctaagaagtctctcttcctctattctggcccttaattcaacccatcttccaatgtggctggaatgatcttcctaaactgtaaattagatattaaacctctgtttaagcagtttaaatgattccctcttggcagtaggataaagttcagtctccctaaggttgatgcttaagctggttctcatctgaacccctaaactgcccagccttgccttctgccattcctctggttaccagccacttccacaaatgccttttttttcttcactttccctttgttctagctcaatgattcctgacttggggaccagagatgggcagattgggacaggagggctgtgaagtcattgcaagagatcttatctaaatacacagtaagcgttgcttgtcaagtgaataaataataccccctgacacaaacacaggcactgtcattttggaccttcacctagatgcgattgtaaagaatgaacttcaaattctgctagaaggaagggttgaattatgagctttcctttgcagttatttcttttctcatcaatggatatgaaaaatacaacatctgcgaagtggagacccatgatggtttttgacacataatagaaaccagcagtgaatcccttgtctcttcttttttattttttatttatttattttttccctcagacagggtcttgctctgtcacccaggctggagtgcaatggcacaatcttggctcactgtaacctctgcctcccggactcaagtgatcctcccaccttggcctcctgagtagctgggaacacaggcatgtgtcaccacgcccagctaatttttgtaatttttggagagatgggttttcaccacgttgcccaggctggtcccgaacttctggactcaaatgatccacgcgcctcagcctccgaaagtgttgggattacgggcgtgagccactgcacccggccccctcgtgttttcttaaacacatcttgatccttcatacctctggctaccttgactgtgtttcagcaccccctgtagcacattataacataatttctcccaattagtcatattttcttaagcatacacaccatgcatcataatttatttccctgttgcttaactcaggggctaatatgcaataggcactttagggatactttttaaatgaataaataaatatttgtgagtgagtagtggagaactctctggagcattggttttcaaagtgtacattccaagggcttgtaaaacacagaatgctggactccacccctgaatttccaaactagtagaactaggggcctgatctgcctgggaatttttcattgctgacaagtttccaggtgatactgatgctgccagtcttgggccacactgtaaacgtcattgtcatactaaattggcactgagatgattctctgtgtaaaaataaccccagccactaattttgggtaagggagacacctagaggggggttttaactgcttcttgttcagagaataaaaattggtgtctgaatgcccagttttgcttctcatgagggactgaagtactaaagacaattgggccaatttaactgagatggcctaaaagtcacccctggtttcatctccattgctagtgtggaagtcatgcttgtattaaacatattcacagaggacactgtattagggcagaacctaaaaagatgaaggagtattttttgtcttattcttagatgtgtgggctctgcctacatcgaggaaattcagaaggatatcacaccctgtgtgtcctccacaaaagatcttcagacacccacaggctcacacatgttcttcactgtgtctagtcctggtctggactattgtgagaagaccttgcatcgtagggagctacatgtgatgggcctctcagcatcacacatttttcaacacaaaagccaattaattcacccgctcaaaccaagtcttctaagcacctgccgtgctccagaccctgttctgagcacgcagcagtaaaaatacagaaatgagcttacattccagaggaagagacagacaacaagccaacagatgtaatcactcattaattattgctacaaaacaaattacctcaaaatataaagcaattgtttattttcaggtcacatacctgctgatcagctgagctgggcaaatttggctgggcaagcatctgtgggcccatgaggggctcatatttcctcctaggaccggcgggatagcccacaaatgctcttttcaaggcatcagtaggagcttttgcgagagtaagctaaaacacagagggtctcttgggacctgagcttataactggtaccccatcccttctgcttcatttcatttgtcacagaagttgcatggctaaacccaaggccaaggggcaaagggcacagatgcaggttggagtgaaggattgagatgacaacgcaagcaacaatgcgtagcagaaggtcaagtaacatagggggccaggaagaaacacgaagcagtgtttgtggcttaagagtgatcaggaatgctacttttggtcagcattctggtagccagggagacttgttgtaggacggtgcattgtcctaatcttgggtgtttttagcaggtgttcccattgtagggagtgagacattagcatgaaggtatgttgcagtgctgtgtgatacaggcttccctgcatgctgtccaagtgggtctctgttatccaggtccccagacacgcctaatcactgggttgttgcataagggctcctagctggattaatcccgctctatacaaatgcctcatcatagcagcacattgaaagcataacaaaatttgaatacattatctctgccggactatatgccagtcactccctccccccagcacacacacacccatgtgcttatatgcatacacacaggaacatgcacgcactcacacagccacatccacccactgtggaatgccttcatcaacatcagccaaggacaggaaacaaactcaacccttggcacccacaggaggcagctactggctgttggattattccctccgtgccaaagctaggctgatgcgtctggaaaaggggtgtgaacctcgaatgtgtctaaaggcagacacagcttcttgaggagcccacagatgctacagcagctggggcttggtcgggggatgatacggggtaggcggtggagtggggatacgtagggctcaactttagtatttatttgccacatcaatcaattaatcagccaaaaaacccttattagggaactgaataaaaagcaaagcaaaacgaagaatggatttcttcttcagaagccttttatcattggaatgaaataatttttcttctgtctttgttggacaaaatatgatctcttgttctttgttgaagtgcacgttctctgaaagtcgagaggaatagatgatagaggggaagagaaacatcaatatttacaacagtcctgggagtgttatcatgttatcattcgcattttattgatgacatactgagtcttagggtaccaaactgacttgcctcatatatgtggaatctgaagatctcagttcaggtctaatctttctgacaaatctttttccaccttagtaggcttggcatgttttgaacctcgtgggattacagaagtgagcctcaatgcctagggagactccagaagacaactcctctcattccttaaaagccaatctgtggggattgaggtgaggaaggagtgaagactggccctttgggcacacccacctggaatcaggcaaggtttactggagccactctgcctgccagcagaacagcccaggaaaaaagcctgggacctttgcaaatgcctgagcaggactttgcaggggacagagtcagcaggattttcaccaaacgacatccatcttaattggtagcatcagactcatgaggtcttctatggcctgggcatcacagactctcattactggtcgtactgccaatggcctccttttatatatagttgatgaatttgaggacaaaccagagaattgcccttggccaaaccaagctgtctcacccaagatttttcccctccttggggaaatactggggcaaaaagcacgtccagggaaaccaatctgcctgacactggcaattaaatgctccaggcttgaagggacatggcacttttgcacatggctcattggctagatgtacacacactgccccaccccagcaacaagggggccagtaaatgcaatcccaccatgatcccaaaaggggaaaaattggaaatatttggtcatcagcactaaggacaagggaatggggagaccacagaaggccagcagaactgtaaaactgacagcaccgaactgtccttagaacacagccttgaaaactccctcttctgagggactgcttcccttaactgagctgctgcagatggaaacctagctagatcctcatcttctgcagtctagtccctcactgtggtttatcacctcccaagctgtcctctgctctctttccctatctttgtgttgctaagccatggactcagtttagctggccctgaattacaagatggcaccttccctggagtggagaaaagtccggatatttcaggatgccttgatttgaagcctgtttgactccaaagttctctggtttactcccacctgtgggaaacgtgaggctagatctccacacacatggattccaaagtgtcatgatctgtgacgtcatctgtcggaccgtattgatcagaggctcagggacagatgaccctatttaggcaaggaaatgagtgggtgaagcagcaagattcacctttcccagtttcatctgggggttgttttgccaacattgccatctgttgggccagtgctggctacagcagccaagcttcagacatcactgcatctttatcaatgaccttgggaccacaggaggtgaccttctgaccaaacagcagccaatgaaggaatcttaaaaggcacatcactttatatttattcagtggttatgtcatcacttaatcctcaccacaaccttgtgagttcagtagaatttgtgttttcattttatctgtgaacaaatggaggcagagagtttgagtaatttacaagtaagtggcagatccgggggctgtgcctagacaatgtggctccagactccttgcccctccctgccttctgctgcatcttgattgagtctagccatctatttctttaacacacactaattgctgtctccatgttccaggccctgtgccagatgctagaaatacatccccatccactggatcttggcatggtccattgctcagtgtcctgctatgttacgtgttacataatgcatttattccggtatttagcccatggaaaataatgctgaaagacattgtatgcatgtttctacaacaaaactatgtaacttatgtttcttttattgctttggctatcaggaagctcttatccaaatcagagcaaatacattagaatttgggcttgtcatttcagtttgctgaacttttccttctggcccagattttctattttggttcataaattctattgcacaaatgtcctttattgtaaaacaccttaaattctttctaagggaaggctgcatggaaatgatacagtaaggtcttccctgcattttcttagattcctattagggaaggcagacctagatgtccctcttaccctcagtcccaaagccccccatttataaaatcccttaagcagtgactactgctgttctgagtacctggaggtagttcagagcttctgaaaggtaacatccatatacaaaaagaagttccttccgatccagatcccagctttggtgccagatgcacatttgaggagtaggtggctagtcagactctcacctgagcagttaataaaatctattgccccttaatggaattttttctgcaagctcgaattgatctgtcatctttgtgatttgtgagatggcagggaagcaccaaacaccatcatgacttgggccacagtggggggaaaaaaggaaaaaagaaaaaaaaaatccactgccaagccttgccaggcgtagaaagggctggaactgctggggccattttatctgatttattggaaatagagtggatcttattaacattttaataaagagaatctttttgcactaggctggaagtggccgccagtcccccgtgcaattccattctctggaaaagtggaatcagctggcattgcccagcgtgatttgtgaggctgagccccaacagtccaaagaagcaaatgggatgccacctccgcggggctcgctcctcgcgaggtgctcaccccgtatctgccatgcaaaacgagggagcgttaggaaggaatccgtcttgtaaagccattggtcctggtcatcagcctctacccaatgctttcgtgatgctgctgctgatctatttgggaagttggctggctggcgaggcagagcctctcctcaaagcctggctcccacggaaaatatgctcagtgcagccgcgtgcatgaatgaaaacgccgccgggcgcttctagtcggacaaaatgcagccgagaactccgctcgttctgtgcgttctcctgtcccaggtagggaagaggggctgccgggcgcgctctgcgccccgtttctgcattcggatcgcccggcacgggcagggtgagggggctttcggggggtcggggcctccggtcgcggcggcgaagacagatcggggctcggtagggaggtcattccgagcccagagatcctaggcaccccccacacacaggctcccactctggcgtgcgtgtgtgtgtgtgtgtgtgtgtgtgtgtgtgtgtgtgtgtgtgtacgttcgttaacgggaggaggagagagctcccagtccttttttgctagcaggggcgacattctcgcccacatcaagtggggtaactttggttccctcctccggaggctcggtgcattggagaaagactcagttagaggcgactccaacgagccgcggttttccccagcccaacgcccagcggccgaagcgctgctcgggtccggattgcgggatgcggggctggagaggccgagcaggcaccaccgacttcccagggcgcccgggccccctggtacagcccggctgcccgctggaaggcgcctcggggcagcagagagcctcagcccggctgctgctgtcgctcaaaggcgccggcgccggccgcacccgcatcggggtccttttgctcccagaccccgggcccgaaagggccggagcgtgtcccccgccagggcgcaggccccagccccccgcacccctattgtccagccagctggagctccggccagatcccgggctgccgcctctgctgccttccctgagcgggagcggagcgcagagaaaagttcaagccttgcccacccgggctgcagctgcttgttaaccctcagagcgccacggcgcgagggaagggcacgccaaccaggagagggggcgagggagatgcggtccgcctgcagtcacctctgcacctcagagatttcgggaagtttgagtgcaggaaagcagcgctccgaggccaggcctggggtgctggccgctgcggggggcacgccctgcgctgctcaggggcctgtggtttcggagagcaccccgatccagtcccccatcgcctctctggcaggcgttgggacttggagtgagctggcagcctgcaagtgggtggataagagccagggcagggcagggccgggcagagtaaggagggaaagagacagggagtgcctcagggtgctaggaatgagtgttgagttcctggccggggtagaggctcaggtgagagtttgcgggtgaaaggcaggggaagggagttgggttcccaggtagggactgtctgggatggggagactggtgcagacttctaagggagaccactgttagagcaatgttgggtttagactttggaaatgggctaacatctcagaaatgcagtgatgggtgatagtaccaggggagattcaagtgcccggctgctgagcccgctcccaagctcctgacttctttcttggatatacagtcccgattaaggactgcccagttatagctccttttctaccaggcttttctggttgattatcttggggtccctacagccttgagtcttgccatggatcccaagcctggctgtgaaccagttttccagatgtcctgtaccctagagaccccaaggctgtatgtgtgtacatataccccaatttagcaaggcggtttggagcatgcctcagacagaaaggattcagacagatccttcctgccatctgctagtggtaccaacccgggcaagttgtttaacctctttgagcttccaagttctccattgtaaaataatctgctgccttcctaggactgctgagtggataggattgcattcaacaggatgtcctatgcaatgcatgccagtctgggagctgtcggtgtctgagagcacttaccattgccttgtccaggacttcacagtcctctttctttcttggcaggtttcaacctcagttcatattccagggcttgcccaaagttatgcctcctttaaagcaagacagaccacgtgacagggccccaggatcgatttttatgcactaagggctctgcgcacggttctttttgcaaatgaactggtgtgtctcctcacccagggccaggctggcacaggtgggttctgaaggctcactctatttatttagatgaaggaagcagagattttgctgtgaattgaaatgattgccctgagaggcttatttctattttcaattgttatgcatatcagagcaaatgtccacattaggatagtaattgatatcctggtagcaatagtacctcacagagaaatcattttgatgcaatccagttaaccagcaagaagttcacgtgcagaactctgtgtgccatagaaaaaagtggggaaagtcttcgaggccttgagtcgacgagcaaaaacacaactttcctgaggcagagagaaaacagaagggaaaaacaatgtaataaaacaaattagtcactcggccctggtggtgttcaggcaagcctgtatgtttttttccaccacagttgtaaagcatcgggtctggctttggaagccatcaatctctgtaagcttattggcttggttgttgttttaggcattttggtaggaggtgaggaattctaagcaacaatgactggaagctggcaccgttgaacagtcacctctcctatcccctggggtgttttgggaaagtctgtcccagaagtggcttctggaatttgcctatgataagtaatgactgtgaaacaaatcaagaaagaaatgagcaagaaattccatggtaaatgtgattcccctccctatttgggtagcacttacaactaaccaaaagttctaacaatgagtgagtaatcccccaagaattaggaatttagggaggggttcaggcttggaggacagtcgcttgggagtgactgaaaatgttccatggaattctgagatttcgctataaagtggggagttctctctaggggtcagagtcttgattttcaggattttcaatgagaatcagtgtcttatagtgctcctgcaaatttgtgtgttatgttttaagagcagtgtttatttgcagaactttttggatgaggaaaaggacacagggttgaagagggtgctgccccctccccccctagggtcaatacatgacagcctgtaagatttccagagcactagggaaatggaatatgtagtgaaaggagtcagtgatagagttcacctgtctgaatatttttttttagcaagtcccaaaacaggtttaataaactgcaaagctgagtatgtaatctggaatttgtgtaattccacagtctatactaaaagccccaacagtcatcttagctgatcgctcctactctgcctccctcccttctccccttttctatctttagcccttgggttttccgttaagtaaaatctgtttacttccagaagtatcctctatgtgttatagtgaaattgcccaacaaaccaacatactcaataactgcattatctaaaagcatcagcacttggatgtgtaaactgagcctcaatctgaagttcaatgtttaggttaaagtgtagctaggttcttgaaaacatccttatttccttccaaaaatacaattgcttggggagtctagttaatttatatttagtggaatgtaggaaaaggacaaactatggatttaatttacacctgaatgacagtcatatcatctacgtagccaacagtgtttctgtgtgcgcgtctgagtgagtgtgtacatctctgcattttgatcttgtaatacctgttgaaaaatttctccagaagagggctccatccacagcattacaaaattctgaatctacagctcattttaaagaacttcaatgcagcaactccatcaaaacaaaactattctccttattccacattaattgccacaatcacccccaaatgagaaatcctgccatttttcactgtatttatttctgtgtctctctctttcttgctttccttcttttgctctcttgctttctcgctagctttcttcttgctttctttcttttcccctattgtagttggttctgttctaattcattctttgactctgtatcccctctgagtattggagcagggaaaatttcaaagatgtttgtagacggtgcaatacgcaatgtgaggaagttctgaaatttcctggcatttgactttggttggacttgatttcattctttaggtagccaaaaggcaggaacagttctgcctgtggaaggagataaccttcccccttacataaccacccagaagggtgactcctgagctaggtccactcactttccatcactcattgaaaaggagaaggaaatatccccctgtcatccaattacaataatcagctggacagaatcaaaccaagtgaccagtggttttggcattgtttctatttagctgtcagccaggtacccatgcacctgtgagaatctgaccctcctgaaggatgctgccaatataattccccacagcccgcttcttctgcagccacctgggatcccaggcctggctcctcaggtatgaacaggctgcacagacaatgaatggctgggctgtaggatctcttgctcctgcagtaggcactcagcagtggccttattctagagttagggtggaaagtcatctttctctgctgagagaggcagcttgggggaaggcaggagaggagaagaaaggacatttctaacttgaagtgctgactgagccagggtctgtggaggtgaatgtgtcaccctctggcttagcaagttgaacctcgagacatctgcttggtggtaatggaactcatctatcccaaacctgcaactctggcttctgggcagaggttgccaagtagcagccacaggctaaatttagccatggatgcagtttgtttggctcaaatgttttgcaaattgtacattaataaaaaagaaatccaggtttctagcatttctgaaaaagtcaggtcaggcaaccctagatccacacttcaacatggccgtacttgacagggctgagtcactactgccctctttaggcaggacgtgcctccgtagcttgccataatcgtcaccactctctactacccagccttctgtgctcactaattttgcctgcttgcccctagggctttttgagtttgggacctctgctttcacaaatgttgaggtttgatcaaattgatgcagtttatttctcagtgatggactatttggaaagggagggactggccttttctccttccctgtgattgaattccattgatgtgtgctttggaacagcatgaccaaggggactgcagcccctccctgagcacattactggcagtacttttggacaggcacccagagagacatagcacccagatcattgcttcaggtgtaagagtcatgcagagaagtgacacgctgcagctctgagtcagtacgagccctggcacaccagtgtgttggtacaaaatgtcatcacgcaccagcagccaagggactctgaaaccctgggatcatatagaggcctgcataccctctctgtcagcagtcctcaaccattttggtaccagggaccggtttcgtggaagacaatttttccacggactagaattggggggatggttttgggatgattcaagcacattacatttattatgcatttaatttctgtattgttacattgtaatatataatgaaataattctacaactcactataatttagaattactgggagccctgagcttgtttttctgccactagatggtcccatctgggggtgatgggagacactgacagatcatcaggcattagactctcataaggagaaggcgacctagatcccatgcacgcacacagttcacacaggattccaactcctatgaaaatccagtgccacggctgatctgacaggaggcagagcccaggcggtaatgcgagtgctggggggccattataaatacagatgaagcttttgcttgctcacgggccactcacctcctgctgtgtggcctgatttctaacaggccatggactggtactggcctgtggcctggaggttgggaacccctgctctacgtagtgttctaccaagagcatggctgtccttggagaacagtgacagctgagcatcatcattccatgagtgttgctccctcacggtatagacataaccagaacgtcacaataacttactctacttagacttgccaaggcctccgggaacactgctctaatattcagcacctttgtaacttcaggataaagctgaatctgcagctctgtcacctactttttttctttgagacggagtcttgctttgtcacccaagccggagtgcggtggcgcgatgtcggctcactgcaacctccacctccagggtttaagcaattctgtgcctcagcctcccaagtagctgggattacaggtgcccgccaccaggcctggctaacttttttatttttagtagagacggggtttcactgtcttggccaggctggtcttgaactcctgacctcgtgatccacctgcctcggcctccccaagtgctgggataaacagacgtgagccactgcgcctggccaagtacccttatccataggacactgtcacatcctagcaccgtcctggagcttgtgtgatgtttttatatctgttttaacagttaacacccacggccgttctacatacagtgttaatgctacaattaatgctctctggctctgtaaatactagactaatctgtctgcctcatcccataccagcaggtgagcctcagatgattcttgttttccatagctacagaccccaaagatcagagtaaatataactccatatacacatatgaaaaaaagtgattgtttttcctctgccagttgccaacagaagtcaaattctagaaaactaacattaacaacaggcacgttttgacttgtcatgtctcatttcaaagacaccaatgagcatcacccgatctgctgcagaggcacaaagaccctgtgtctcctagctgaacgcagcccgggctggggcggagggcagcagctgctcagccatcaacagccctgccacatgcctgggcagggcccggaaatgagctcagcctctggaggagcctggggaatggaaggaaggaatgtggcagcttccatccttgccttacggggccttcaggccaatgtctctttccctcaaggtgtcagggaaccgctttcttgtgttgtgtgctgcaggaagaaggtggtggctgcagacacctgaagcttgagcttctgtgattgtctccctgtggactgattgctgtagggcctgcggaaagttgctggacactgccagcggaaccgaggctgactcagactgcccggagtatccctcctcaactgccatcagccgtcgggcatctgggatcatctcactcaggggttgcaaattatggcccgtgagccaatttctccctgcagtctggttttataaatagttttattggattatagccacacctattcatttatgtaattgtttatggctgcttttgtgctataacaacagagttgagactgtctggcccctgaagctgaaagtatttactatttagtccctaaaagaaaaagtttcctgactctttatctaacttaaagttacagccaaagaggcttctgggcgtcttctcaaataagaggggcctgagaagttcagccgttggggacttttcctcctaggccccaagcacttgagcaacttgacttcagggagattcacctgagaccaaatggttccaataaatatctatgatctctatggaggatctactatgttccaagcaccacttgtgtgtgcaggatacagttgctcataaggcagactgagtctctgctctcctggggctcacagcttggcaggaaggatcaatagcaattaatgaataatttaagatggagacaactgtgatgagggaagaaagcccagctgtgtgaggtcatgccgttctaaatattttgcctaggtgttctttgtctttctcctccactagactataagctctgttgtggtccacattgtggcttgatttgttcatttctatactcccagggcttagaacagtgcctggcacatagtactcagcaaacatgaatgaacaaatgaatgaatgaatataagaaagacatcagaggcagatgaaggatctgggcggcttccctgacaacctgatgcttcagcccaaatctggaggagcagtagggcttacagacaaagacacagtagagggtgtgggtggggaaaggcattccaggaagaaggcacagtctgggtgaagcctctattcaggggaaacaccacacagccaaggcagtgatgtgaagtgtggctgggaggtgccagagccaatggggccatgtcagccactgcaagaatattggtgtttttctcagagcaagtggcagccattgagggtactgagggaaaggtacagagtgatgtgatcagatttgcattctggctacaagtagcaaatgggttggagctgggtaagaatggaaaggaaaggccagtctagggctgagatcatgggaagctggattcaggaacgacggtgcagagatggggcaggtgattgaagtagactgatatggtttgggtctctgtccccacccaaatctcatgtcatattgtaatccctaatgttggaggtgaagcccagtgggaggtgattagatcagagggcggatttctccttgctttaatcgtgatagtgagttctcacaagacatggttatgtgaaagtgtatagcacttccccctttgcgccccctctctctcctgcttgctgtgtgaagacgtgcctccttcgccttccccttctgccacgattgtaagtttcctgaggcctttgcagccatacttcctctacagcatgcagaagcaagccaattagacctcctgtctttataaattacccagtcccaggcagttctttatagcaatgcaagaatggactaaatcctattcagataatccaagagacatttaggtggataacttgacaggctttgatggtggctgggtatggagatggcagggccagagagaggtgaaggaggcctgcttgagttctgactcttccaattggcaggaagagtcaaacaaggagaccaggtgtttgacattgtaaacagggtcggtctgagggcttctctatgtgggagtgtaattcaggctgcagaacgttcctgggagaggcacctaaggcctgcattacagtattgccagcagatccagtccatgcctgcatctaggatgggcaccgtgggggcctggaaatgcccttgaataaagtgaccgacgtgcagcctgtacaattaaccaatctctgagacttttcatgcacaagatatttgagagaaacattgccaagccctttaatcgtttcttgaacattcaatcagcagcactggaaatatgtcttacatgaagcaaataatgatcttctaccctcagcaatcgctttgccaatgctaacaagcctctgcttcagcatgttgggtgtagccttggtgacttctgtttgtggtgtagtaggagaatattcaactgggtgccaggcagtggtatattggtaaatgtttaacaactgggccactctaaagaaacacccaaaccagaaagcaaaacccaaaccaagacacaaccaagtaatttgtagctcttgccaatttctgtgatgtaaatactcccgtcatgggcaatttgaatctgccaacctgagagtttcctaaaaacttaacaaggggctcttgctacctgatactaactggctccagcacaccatggacctggatcctgtttctagctcaccccctcactcgtggtatgaccttcagcaagcagcttgaatgttttcatctgtaaaatggaccaggttacttggaggttcaagtgagtaaaaagatgttagaatgcagggaagtccaatttgctgcaaagatgcatgcagattatctaaatcattatcacttacaaggaaacaggacctttggccaggatcctacagctgtctaattgggccctgtaaaaatactttgattcagccactgaatgaagtttgatgtgtgagaaacagagggtgtacctctgcttcctgcagttctgcatgtttttgcagtaagaaagattattgcgttctgtggcagtattgattccgaacgtgtctatcttgtttttctgctttcccttcttttcttccttttctcaacaaagatatttagtgagtgctgtatgccaggcactcacctaggtactttatcctcagaagctgaggtctgtacagttactgtgccttttttttttttttttttttgagacggagtctggctctgtcacccaggctggagggcagtggcgcgatctcggctcactgcaagctccgcctcccgggttcacgccgttctcctgcctcagcctcctgagtagctggggctacaggcgcccgccacagcgcccggctaatttttttttttttgtatttttagtagagacgggttttcaccgtgttagccaggatggtctcgatctcctgacctcgtgatccgccagcctcagcctcccaaagtgctgggattataggcgtgagccacagcgcccggcctatcgtgccctttcaacagatgaagaaactggtgagtttaaggaactgacccaagatcacagaataataagtggtgagctgggatttgcacctgggtctgtgcgtgggcgagtccacctggggcccgtgtcttcactcagcgagtatttattgagcatttagggaattcagaggtaaacgagatgaactgaatccctgtctcatggagcttacagttttgtgggaacagcagataaaaacaagtaagtacttgaaataattacaaatgtggtaattgttacaataggaagcagtagaggctgaaatccattgaagggagaagaggctgctgtgccttcctttgctcctttgcttcctttcatctgccttgcctccctctttctgctgtctttctttctttcttcccttaaatgttacctaccaactatgaagaacgctgcaaacctgggaacccagaggtgaacacgacagtccaggccttcactaggaaatgtgctggagcagaattagagcctggggctggcctggacccagagctgctggtgccttggactgcttagggactgctgagcagacctcctagccctttagaagtgagcttgaatccctgcccagccatttacacactgtgttgcctcagataattgacttcatttccctccttttctgttttcccctgtattaaaacaactgaaaaggaatatctatgcttgccctgcaggatttttgtgagaattaaataagtgtatgttaatgatgtcatcctatgcttaagaaatgttggttgtattacttttcaccctatgctccaaggaattttatggtctgaaggtgtcatggggtcttggctttcaggatgtgactcacttaaggggggaaatgactgtgcatgtcataatgcgtggacattaaaaaaaataaagtttgctccccagggaggatttgccaattcccatattagtaggtcccccaagattgttcccctcgggattcatgcctcataaaatcatttgatctggtgggatctcatcttcttaatgtgtctgcccatcatctgttcctgggaggctttattagggcagtgtgtgcgtgtgtgcgtttgtgtgcatgcacgcaccagtgccatgagtacttgtttaaagtacctccatgtaaccacaattcactgtagttgctatgcactagttacccatgttatctggaatccttcctgcaacccttagaggcgactcttattcccaattttatatacgatgagaagaagttttgagtggtggagtcatttgctcaaggccacacagtcactgagaactgggaccagggtttggacccatgcgtctttattcctgtgcatatttattttcctctatgttgcactagtatataaaagttgcctttcccactcccctcattatataaaaattctttcctttgtctattttgttctctacctcccttaaagtcaagatagctgcctgggatgactacttttttgagttcctagtctctcaaagtgggtctgggccctggacttcctgtctgggctactgattgcaaccttcagaacagggtcagcccggggtcatttgtgttctttgtctccatgtccttgcttttgaccagggccaaacaacccacctgcactgcatggttcccccagcaagaacatcccagtgagaatggcccacagatgcctgggcgtgacccacctgcagcttcaaccatgcaggtaaatttgcctgctgctgtgtcgtgtggctggatggaattcttccctagggatgctaagaaaccctgttgcctaagtcagtgcttcctgcaagctactctttgtaattctttccccaaacaaaaagaaaacaagaaatatacagtctgtagctatatagagacacctggatctatattgtgtggcaattggattgaatgtaacttgaagtttatttttgtcttaccagactagtgttttttcctgttaatttaagtgctttagtgagggttgccattgattgagcaaacatgtgttgagtgcttattatgtacccagctccattttccgtactagccacagagcagcgagagcatggcctttgccctccaatcctgttctggtggacagacactctctcccttgacagggtcctcaccactgtgtgcaccgtcccgccacctggtggccgtgcctatctgtgcattccctatttggttaactcattcacttaacaaatatttactgggggaagacaatatctcaagcacaattctcagcattgagggaggcagcagtgattaagaaagacaagattgcctgcccccgtggagtttgtgttctgatagcagagaaagacaggaaacaagaaaaataaataaatatggtagttttgcgtagtgatagtgctatagaaaaacgttcaaatggggtagagtgatagacagtgttgttctgagcttgtccaccacaccctcttgggacagaggattctttgttctgatggaatggcctttctatagcatagagatgaaatgtgctaccgtttgtgaaaggaagttagtaatacatacatggcatttttgtcttcactgataaagtgttgttggtcaacttttgtcaactctctactttttgtttgtgttgaaattttactgttgggaatttacgaatatggcaactaatgatttaaaccaggggtaggtatcctttttctgtaatgagccatctagtaaatagctggtttctcttgaaactgttcaattctatccgtgtagcattaaagcagccacagccgatatgtaaatgaatgggcagggtaataaaatgttatttacaaacacaagcagagctagattggtccttcaggctgccatttgccaaccactaatctaaaccagtagctgccttaccagttggtcaaacttgtttaagacagggatagggcagaggccagcgaggggaaccaggcattctctttggcctcagttgccatgaaaatcatggtacttctttagggtcacatatcactagattatttgcattaacttttatcaaggtaaagatgctaatagtcaactatggaacataattctcagagtagatctaacataggaataatttagctttgtaatatttatctggactacaatttttaaggcacttttgctacccaaaagtatcttggggttaaacacgctcttggattgaattcctctaaataaatagagacacagaattgggttcagggggttaagttggtaaatgatctcaaggtccataagtgagcgagtggggagagtgagaccaagaagaaggaaagccagcaagccaacagtgaatgtgtcattgaggtggtcacagtcatgggaaactggcttcttgctgctgggtctctacaaaagcactgtgtaaagctcatttccgaatggtccctccacagaataggtggctgagggtgtattcactcgcccttatcttctgctggtcaggggtgacccctgccgtcattaacttctctgtgcttccctgctgagcctttgctgtcatggggagcagtcatgactttggaagcatcatagcagaaaaaatggaaaggtatggcaagttgttggactgtcaggatatgccctgggtagggtatgaatatatgtgatttctcttgccaccattacatgttactggaaacttcctcagtagagctaatggtaacagaaagaattatggtagtggtaatttttaaaaccttctgaatttggttaagcaccctcctgcagatattctctttcccactagatggtaccagtatgccaaagccctagaatgctaccttagggcctcgtctttgacatgtgatatattctcattacttttcaacaatgaatgaataagccagttgaggtcaaaggaatcaactatggatgttttagggacaggagatgggagaaaagtggaggctgtctaaacagttaccctcattcacgcattcagtcatttatcaacaaatattactcagcactgactgagtgctcaacacttttctaggcactgggaatacagaaatgagtaagacaggccaagtccctgctctggtgagcttatgtactggctgggagagagacaataaaaaaatgaacaggtaggtatgtgatgtctgcaggagggtgatgagtgccatgaagaatgagaaagcaggcgagggggtagatagcgacaggcagaggtcatggcgcttgccttcgctgttggctgtagggtgagagattattttcatctgcttcccaaacccagttcttccattcaccaactccttatgacacccctatgcggtttatttttgaaatgaaactaacagctcatggagggcaaaaaaaaaaaaaaaaaaaaagtggtgcttggcaaatgtgtgttcactagtcggggcccactgcagcctaacacctaactcattggactgcttgttggctgatttaatttgtctggaatatttctgaattactattgttgttgacacacaatagagttgcatttaactcagaggttagactataaggtcagggttttaggcaaacacagttgtcattagccttgaactcttttaagttgcccattaaagtacagtaggcgtggtttagtctatgcatccccgtattgtaatcaatagggaacaatgtataatgcacgcagtaatgtacagggcataataaagaatatatgcaagatataattttatagcatttaattgcagtatttacattgttctttttctctctctctttggtgggagagctggctttccattagttaaatgtgcatatgatgagacttgactatattcatttaagccacattcctaatcatacaatctccaccagactgtgcattacgtaaggcaagacctgttttctctgttgtgttctgtttatctttggattcccactaccagtcagatgctttggggtgggggaattgaggaataataatagtagaagtggcagtaatagtagctgatatcagtgtggtgctgattttgaaccaggcctggtgtgagtgcttcagatgcattaatcagcacatgtaatcctcatagtgactctataaaatatcttctatggttttaatcccatttcataggtggggaaacttcaggagaacttagtaaaagaacctaataaagctttaggactctagggctgagattcaaactcaagacaattccagacacacaagaccacatgttgtatgattctatgaaatggaacaaactgtccagaaaagtcaaatccagagacagaaagcagattagaagatgtctagggctgggggcaggaggaaatggggagttactgctaatgggtatagaattgctttggggaagatgtaaatgctctggagctagatagtggtggtgattacattagctctctgtaaataaaccccaaacctgggaatcatatatcttaaccggctaagctttatagtatgttacacatgtctaaataaaactggtattgaataggaaaacaagcaaaccttgggcaggtcagcctcagggctcctgtttgttcatgagcacacaccacctgtcttacagttgttcaccacctgctggtgatactctacttgctttacttatattaacactgcgactcctcaaaagatccccattgtccaccctactgagatcagaaagcggaagcagaacgatgttgagaaacttggggctggcaagtggtagtttcaggattaagacccaggctgtttgggtctaattccttctggctacactggttcttacatgtgtttcattcattaaaagcaacctgtgttatttggaactgcaggtcaccttggcctattggaaataaagcaagggttcttcacgtttgttttgctgatttgtaaagtgaattaagaaccatcttttgcctcactggttattattctcatagtagcctaccctggtgtagagttctggctgcaaagctctcagagactgaagaaaaggagatggtttagtgttactgactttttttaagacagggtctttctctgttgcccaggctggattgcagtggtgcaatcatagctaactgcagccttgaccacctgagctcaagcaaccctcttgcctcagttctggaaatagctaagtgggactacaggtgtggaccaccaggcccagttaattaaaaaaaaaaaaaactttaagacaaggtcttgttatgttgcccatgctggtctcgaactcctggcttcaagtgatcctccaggagtagctggcattacaggcttggctgacttttaaaagtagtaagtggtttaggatggggggtggtatggaggtcgggtggggagaaagaggagagaaatctaattgatatgctaattgtcattgtactcaagttgatagcagattgctgaaggatttaggatttacccaaattaacatgaatgtttggcaccctttggctggtgcggctgaagaattcaatagcctagtaatgagaagtcaatctaaggtctaaggctgggaaaggagctcccacttcttacattcagtgctcatcactctgcaaatcaaggccccccgaactcctcccacccctgccttctgcgtctccctctgtgctctccatcacccccctacggagttcctttgattctcaggtcccttaaccatggaacgtactcctgtctgccctcactcgtgggttgatgatttctatcctttgtcatgttgaaaatgctgagtgacaaagccattagccatgcacagtgaaacaaggaaagcagcctagagctggtccccagaccaggcccagtgcacgagtttgggtgctggaaggggaggctttatggaggcaaagctgaggggctgtacgtgtcttcataggtctccagtctgtaaaagcaaccacgctttgggctggggcagaagtcaggacttgaactggctctggctgggacccaggctcccaggtagccagctcccaggtgacaggagtccgctgggctccctctgattcttaaagcctttccaggtagcaacaggagatcacgcaaagccacgtaagtgtctgattcagtcctccctggtcagttttccagcatagcgttttgcaaaatgtgttctgaagagatactggttccatgggaggttaatatgggttctggggaaaaaaaattaggggaatcaaaaaattacttgtataaactaatattttggaaaactctggagttagagaagtggaccagattgggttttgttttttcacaaatgaaagtctctgagattgtagtgtgtttcagtttcagagggctcttcccaaacccctgaggttaaggaaactcttgtacacagtgggtctcgggcactaactcacagatcacacttctgaaaacaagctcctaggatgccatatctcagagtacgggcttcgacggggcccttcacccagctccaggaccaactgggagcctgttaggactgcaaatcctgtcctctggacctagagaatgaaagcctctgggggcaggctcagaaatctgtgtttccagattccactgggttttcaactccatccagaataattcttctggtgtcactgtgaatatttgctgatccttctgacgtctatccgtggtgcttgtttctgaagtgtagtctaaaccgttggctctcaactgttggggtgaggggggttgtgaccctcgggacagtttgcaatatctacagacatgcttgtttttcacaacctggggaggggagtgggcatctagtgggcagagctcagggatgctgttcaacatcctacaatgaacagcacagctcccaccacaaaaggttatcctgacccaaatacagtagtgctgaggtggaaaactctgatccaaatgcatagcttcatactcacccagcacacacagggatttttatccttatcttatcctgttattactaggaggctggaatctgaagctggggctgtgaaaagatacctcacagcaagccgctattcatgtataatttttcaaaaggtaaaaccaagactcttgggtaaatacgcacttcaactcattaatttatgaagaaaccagtaagatgccatggttattccaaagggcatttaagaagctaaggtattcgtaaggaatttagcaaagaaatgtgaagacgagattgctgagttagataaaaagtggttaatgttcatcatgcctaaacttttgggggttatctgttctattagataaaaagtatttgcatctctactggacaaaagttgaccacttaagtggtgacttcacaaagtctgggatcttcaagagcaaacaatgagatgaactaagagcatgctcctaaacaacttcaggttgtccctgactgataaccaaaggatgtgccatcaaccatttgggccttgtttgcaagctttgaataatttttctggtgctttaaacacattattgttagtattttgagacggagtctcgctctttcacccaggctgaagtgcagtggcgtgatctcggctcactgcaacctccatctccagagttcaagcgattctcgtgcctcagcctcccaagtagccaggattgcaggtgcctgccatcaggcccagctaatttttttttgtatttttcattgagatggggtttgaccatgttggccaggctgatttcaaactcctgacctcaagtgatctgctcgcctcgacctcccaaagtgctaggattacagacatgagtcaccgcgcctggcctaagcacatgacttttaatttactggtgctgcatggtctgtgaaaagtgggtcaaagaaatgggaagtgatgggaggagaggtcacaggaggccaaggttgtaatatggttagaagccatttcttacctgtcttctatgaagtgtgggttgtgagcgatgctttcattcaaacctatgaggtgcatcttgtcatcatccccatctacagatgagaaaactgagtcagaggaagagttaggtatgtcagtagcaggcatgggcaaaggaaggagaaagtaatgatcaagatgatagagggagaattgcaattaagccagagagaggaaggatgatgttataagctcgagggaagcctgagtccagatctgaagcagatatactcacagcacgttcagggggtaatgaagaggctgttatgggtgactatgaatgtgaaggcaacgtgagattggatcagagttagaaagatgacagttgttaatagcatcagtgttattttagccaaaggactttactattgctgtagtgcagtgcctcgcagtacaccatgacagttaagagcccaggcctcgagggaaggttacagtttgaagcccagctctgccactgtagggctgtgtgaccatgggcaagttgcttaacctctgtgcctcagttaccagatctatgaaatgtcggcagtgaaacctagctgatatgactgggatggggattccagagaaccttgtaaacacttggtccagcaaataatatggcctcagaaaatagaagctggatgtgtttacgtacatgaggaaatggacagataggacttaacagaccatggttgtgagtgacttggctgtaagtgtcacagtctcagtttgagtttcctcaaaagcggatgctgtgaggaggatttgagtgcaataaattctcttgggaggtggtccaaggggaagtgtagaggagtgggaaagtgaggcaaggaaggaaaaggaaacagacgaggggtctgttactcaggcaggtactgctctgggtgtctggagcttaactcccctgggaacctttgagaatcagtgtggaatacctgcttccaagccatcccacctgaggggcatgggagctccagattttatgccacaaatctggttggcattgattcaaagctgccccagggggcactgattttgagactactggactactccagcctcagagaaagcagtcagtgaagaggtgtagatatttgcagttggaagttgagccagccctgtaatggaaaagccagaagagacaggagcttggggttgggtggtgagctgtctgtcagtgtctaatgtggtaagtatctgatatggtttggctgtgtccctgcccaaatctcatcttgaattatagctcccatagtccccatgtgtcatgggagggaccctgtcgggggtaactgaagcttaggggcaggttttccctgtgccgttttcatggtagtgaataagtctcacgagatctgagggtttcataaggggcagttcccctgcacatgctctcttgcctgctgccatgtgagacatgcctttactcctccttcgtcttccactgtgattgtgaggcctcctcagccatgtggaactgtgtgtccattaaaactctttttctttataaattacccagtcttgggtatttcatcatagcagtttgaaaatggactaatacagtatccaaaggcataaaaatagtcatgcactttggggaagtaatacacatctgagaagttaaacagaggtaaatacaggaaaatatgtacaaaatacattatattaaatgatatatgaatattgtatatgttttatgcattgtatgtgaaatagtaataatagccaacgcttaggaagtagttgccacatgcctgactctcctaaatgctctgcaaataggttagatttccagcaaatgaaaacaggttaggcagctcaatagaatattacataaccattaaagaggatggttataaagatgatgataatggcatggaaaaatcatatgaatgagaattgaatactaaacaggagattgtgtgtgcagtaggattcctacaaagcaaaacaagcctctaaataaagaaaaagaagggtggaatctgaaaggaatttatcaaaatcctaactgcaattttgttcatgcgttgggattcagagttgttttttcccctctggtttacaagtctccattgatacacttgcgttacatctataatgaaaaatacaagaaacttgaaaaagtacaagaagaaaaaaccttctaaaaaataggtggtaagacccagtgaaagttttaaagaagggaataacataatggaaaatgtatttcagaaaaattaatctgggggcagtgtggaagatggattgaatcaggaaacacccaaggtgagaagtccagcttgaaagcttgtatgagttactgggagtatggaaaagaaagagccaattttagatggttgatcatgaatgagatgatggggaagaaagagaaaagtgccagaaatgattccaacattttaaagcattttgaatggaagaaaataagcaatggaactaatataaatatagttagagagtgagcgcgcaccggctttctttacatttgttgcttgtttaaacctaacagcaatcctatatgctatgcttttaatattcctattttacaaatgacataatagaagattagagaaataaagccacttatccaaggtcacacagggtccaaactcagattattgtgaaatgaactggctagatagaaggatagatgatggatggaaggatgaatgcatagatggaggatggatggatggatgatggatggatacattgataactatatgaaggggaaggaatctggtgaattgtaatgttatagtggaaaatagggcatttcaagaaggaagtggcagatagtcttaggcagtgaagaaggaagggaacagagaaagcactagattcaacaaaaagaaccagtcactggtcctctttgagaaggtccttccagttaaataatggaaagtgggcttaagcagcatgggggactgaagggccaggacatgttggggaacctgtgaaatggctagtcagagcatggcatgtatgagcttaaaaccagatctgaacctaaggaagagatccaacaataggaaggagaggggatgtaagagagaaaaatgatggggaagggagaggagggtaagaagacatggaaaaatggaaaggaaagaaattactggttaagaacaaggacaccagactgcctgggtttgagtctcaactccgctgccctgtaaccttgagcaaaccccataactgtctctgcttccgacccctcatctgttgaatgggaaaagagtaataagctctatatcctggggttcctgagaggaggaattgaagcatgtaacatgcttaagacagtgcccggtgtgctgtaagttgaaactgtgtagggatcctgttgccttagtcatcacaacaaggaccatttcctgggcaacaacccaaagctatagattaagaaactgaggctcagtcacttaaagaatgttctctgagaaagtacacttggagcctcaacattgctctacctgcaagtagttacctctcctgtcttccagggagaaatagattttgtgtaaaataggatgcatggctttgttagtggaaactaaccttcagcaattgtaataaatgaggtacgtgaggttgcatttttttctcctttttgaaaaaagagttaataaacagaggctgttcaataaagcagagttagaaggagtttaggaagcactggagagtggctgaggagcaaggtagtgaggacttggaggacctggagaaggcagatgagatccatcagatcccagaaagctccatcaactcagtgccctttctctattccagaaagtcttatgctcatatcattgatgcttggagaagcctgcacaccacagacttggcatgagaagtcctaaaagcctcattaacccaaccacttaggctttctgagtgcaacccctaccctattctatttgggctcagggtttgctgggccccaaaatgtcccgctgttgggatgaggagattcagttaatacctttctttggttggctctcctcccacatccccctacctctctagccttggtttccagaaaactgtatctgtgctcagcctgctccctcctgcccttggtgatcatgaaacctgccaaagaagcattctctctgaggctgagccactggagaagttgcacatccaggattgattttgcatagtgtagaaatcaatccggtgaacctggcagcataggtatcctctaagtttggttgtaagcccagtggggcagggcagtaaacagtttaaattggaaagttaaaacaataaacaggagagacaggtgaagttggggtttgaaatttgctgggctagaatgggttttctctttctgtgttaatcttatctggcagctaatctttacctgtcatgtggtttttgggggagaaaacggtaccctctttagactgcttccttttctgggaggagaaccctgagaaagactatcagtttgaagttgtccctcctgggatagaaatttatctaattttagtgggtggcaagactatgaacaaccatcattatctgtgctccaataattattaatttaatgacattttaacaaataagaaataacttttattgagcactgtctacatatcaggcacccagctaagtactttcacatgtgatgtctaattaaagcttctgaatatgattaacttcattttatagctgaggagtctacagcctatagggcacacacacatataccatcttcattgatcttcacccaaccatcagaagcctgggaaagacattttgcagttaagaaaagtgaatctcagggacttgtcttcttcagcaaacaattggcagaaccacggtttgaatccaggtcttctgactccatattactttgattttattgggagagtatatgggtggcgtatcttcttaaattcctctggccaggtcctgagaaaagcatttactgtgcattgtctcaacacttgtaataaccctattagggaggtggtgtttttccactttacagtgaggagactgaggcttagagagggtaggtacgccattggaacaaagccactcaggcagttgtaggaagtacagctggggcttataccttcccattctaccctccaggttttccctgctataagcatttcttacagcagtgccttcaataggagaaacaatgacaagtgatttttccagtgggacagcaagaaggtgattgtggtcttggaccttgggatttaggacgggctattgacattaacagttggataggctgctaggtcagtccagggaaaagcaggagggaagataagacatgactgagaattcaggaagggccagcgccatccaatcagaacaagttggagcttttcgtcttctttaagcctactagtttcacttctcattttgaaagaaacaacttgctcggccaacctattgttgctgcctttctctgcctaccacagctatgaaagcaaagttattggaacatgtgaacgtcactagcatccgaggcaagatttaggttctgaaaagaggtcatcagattgtagagttggatctccatttccctggagagtcttgtgcttcagaaaatcattattggtttgtcatcctagcctgtcatggtggaacccctgggctctgaaagattacaggaaaatagctggtccttggcagttctcagaaggttctgtttctcacctgggccaggattgtgcctgtggtttttgttcatgacaagatgagaagagcttggttaaataaggaacgacctctcgttatatatcttctatcctgattgattgcatcagaaaagccattcatctggtttgaagatagacaggtggttgctgtcactgcaccagcagcttttgaagtttgctcagtgatatgattacagcccatacttaagcttctgctccaggaagtgagattgacctttgatcctactcctcatttaaaaattacagatcttggaaaatgaaccaatctagaaagatattggaagctgctgctgctgctgctgctgctgctgctgaggttggctgtcaaaccaacttaactggcctgcattacctagaattgtttttttttttttttttctggttaaaaccaatgacctttaaagcctttttatttttcctctgacaatctctagtggacctatggtcttttgtgagttctgatgggaatcccagaatctttctgtaactgtgggttccaatgagagaggcacatttaacaaagaccagaagaaaatcaaaactgttgctcaaactgacagtgtatgttcttcatcccactccttcattagctcattcattcattgattcgttcattcatgtgctggctctttgtagaagttgggggtaaacaggcgaccaaaaggtagtccgtgaccccaggatgttgtaattcagaagggtaaacagacaaggcagtcaacattgtccattcagtgtgaatgagcttgggagtacaaccactttggaaacccattttgttaatttacctttgatagatacttattgaacggtttttccaagtgtctgtgaagaagacatggtggtggtagggggtgggtggatggtttctgaggacctgataatgtttctccttgattttagtgccagttacgtggcaactcatggaaaacattgagctgaatacttgggcttttgcacctttttgtagtgccttagtgtattttacacaaaaaaataaataaaagtatgctcagcctcaggtgtgttggaaatacagaggagagaccagcccaactttggaggagaacagagagagggacccaggaaggccttctggggaatatatttgacttgggccctgaaggagcaacagaaattaggcactgagtaaaatgggactggatgtacctgcacaaagccagcagcagaagaaaagacatggagtggagggagctggcagttcatgcttgggggaagctgagagttgcttgtggggctggaggccaaggtgcagggctgcaggggtaggagggagcagccagggagggggtggattggttaagaaacacgatgtgcatgtcatgttgagaaacttggatttcaccctggaggcgcaggaactaggggggatttttcagcagcagtgacagacgctcttaaatctgggttttccaatgatcagcatgcttgtgcctgcaccggggcgcaggatgggagacagatgccttttgcagtagttccggagaagaagactgaagaccacattcaaggccctgagagagaagagaaggggacagataccacagagatcatgagatatagcacaacagataagacttgctaattaactgtacggggttacagggagggacagggagaaatcaggtttcttccagcccagcttctggttggaatcactcaggcagagacacatgggcctgagagaggattccccttatgacataaagccgcaaaaattctcattagtcattgcaaaaacatctatttccggcctacactgcaccagccagtgggggaggtcctgagagatagagaaaggatgaattcttgcccttagagagtcacctagagattctggggagacagcaggtccgagtctctctgcctgaaacctctggacagtgtctttggctgacacttacatggtggtcttggtttcttattcaaggtcggtttcccaactctcatagcatcagctttagggcatccccaaatctcttgcagaagagatggttctttccccttgagttgttttgagccaagcatataacattgtgtgaatgtttgaaaacttctcttggttctcagaatgcaattctgacagtgctgaaggctgccaattaaatgaagatttagataaaggctgtgtgggaggtggaatgcaatattcttaaacctaataatggcttccttctgtctttttgaagctctcaaataatcctgattgactgactctctgctttgggcattcccattttctggacaatttaataccatttaaaatgtttgacaacttttatttgggggcagacatccttaggggatggggccgtgggcaaagatacaaatgctgtaccatcaaaggaaccatggatttaaataaggatttttttttttttcatattcagaagaggtgggtacagaaaggatgagggcagcttctcaggttatagtattaaccacgtgaagcagctaacaaaggtatgtgcctggccttgtgctaaaggctttcctcgtatcagttctttcatccctcccaacactactgaggtagatggagtgactagatccattatacaggcaaagtagctgaggcccacagccatagcaaataaactgtggagctggtggtcccagatttcatgcttttagtcattctcttggctctggggtacaggtaagcttccagaactggaggatggagtccaaaagaaactcaagataatttccctgcctttcccattgtatcaggggattcatctgttcatacattcattcattttcccaacacatttactgaatgcccgcaagcaccaggaaaatagcaatgggcacaaccaggttcctatcttcatggagctattgctttattggcagaggcaaacagtaaagaaaattcattagtaatcagtgttgcaatcaatgagccggtcaatcaagcaccataaaagggtaaagtgtgacgaaggtgctccttgtgataggggttgggggtgaggggaggtgtcctggagaggagacatttcaactgagatctctctgaagtagatgagatggccatgtggatctcaaaaggaaagtgtatgccaggaagagcaaaaagcaagtgcaaagtcctaaagcaggaaatagtgaggctaccgcagtgtcgggtccaagagtaggagatgagatcagggaggcagattaggctgcagggagggtgtgcgtgtgatgctgagagtgatgggaaaccactggtggggttgggggagggcaaggcagtgacatcatttgtttttatgtgcagcagaggaagccaaagcaattcagaagaagcctacagaagcttacctcctccacaggctatttttttcttgtttacatttgttaattttacatatatattaactcagtcctcacaaccaccaaatgaaataggcattgcccttattatcattctttcccattttaacaatggggaaactgaagcttagagtaggcaaggtcgcccagataggaagcaatgccttcgggtcatggctcactactcaagtgcctgaaatttcagctagcctttagtgggcacctgctatgtgccaggatctgtatgaggtttggcaccacctagacagccccttgaaccagtggcatgtctcaggacagtgtgagagacagaaacttcagctgagagttaccgtgcaaggcagaaaatgctggtctagcaaaaggaactctgatttcgatttggaagtacagagaaagagcatctgccttggacagagttatcagtgaaaagatgacatatgagctgagactgaaaatcatgttgaagatagtcaaacaaaagctggcagtgtgggagtgggggcttcaagcagagaatcagtggttcaaaggcacagggtagaaggagaatggcagctggctcagtgtggctggagaaagaggctggagtgcacctggttgcatttgaatggtgtgcgtgtgtgtgtgtgtgtgtgtgtgttaatgatggtgatgagatgaggggctagagaggaagacaggttggcacctggtagcattttttaaaaagcaagtaaaccttattttttagagcaggtttaagttcacagcaaaatttggtggaaggtacagaagtttcccaagtacctcctatccccacaaatgcacagccttgtcccactatcaacatcccacatcagaatggtacatttgttacagtcaatgactctacattgacacatcattatcactcaaagttcacagtttacatgagggttcactcttggtgctgtacggtgtatggtggatacatgacaaatgtgtaaattcatgtatccaccattatgatatcacacagaatagttgtacagccctaaaatacttgctctgcctatttgcctacccactcccttctccctaacccctggcaatccaccgatctttcttctatttccatagctttgcctttcccagaatgtcatatggttggaataatatagtatgtagccttttcaaattagcttccttcacttggtaacatgcattgaagtttcctccatgttttcttatggtttggtagctcttttttttttttttttttagcattgaataatatttcattgtctggatgtatcacagtttatccattgacctacttaaggatatcttggttgcttctaagttttggtgattacaaataaagctgctataaacatttgtgtttcctcatatagatcttgtatatatacagtagttccccagttttcatggggaataagttcccagacacccaatggatgcctgaaactatggattgtaccaagccctacatacattatgtttttttcctgtacatacctgtgataaagtttaatttataaatgaggcacagtaagagatgaacaacaattgctccataaaatggaacaattatgacaatatgttgtaataaaagttacatgcatgtgggctgtctctctcaaaatctgttgtagcgcactcacccttctcttttaatctgtcagtctgataaccaagatggttactgagtgactaatggatgatgggtaagatagacaggatggatacactgaagaaaatgataattcacattcccggcaggatggagtgggatgacagaagatttcatcatgcaactcagaacagcatgtaatttaaaacttatgaattatttttggaatttttctatttaatattttcagactgtgattgaccacagttgagtaaaactgtagaaagcaaaccttggagaaagagagactactgtattttgtacatttcatgtacacagtttgctagatttatatgtaaatattccaatttggggagggtaatgtaaattgtattgtgttttaaattcctgatttcattcattcattgctggtacataggaaagtgattggcttttttacattaacctcgtatcttgtaatcttggcataattacttattcttggagtttgtcaatttttttggatttcttacatagataatcattttatctgcaaactaagttttgtttcttactttccaatcactatacctttgttttcttttcttatcttactgcattagctaggacttccaggacgatgttgaaaaacaatggtaagagggcacatccttgccttgctactgatcttatcaggaaagctagtttcctaccatgaagtgtgatgttagttgtaggctttttgtagttgttctttattaagttgaagaagtttctgtctgttactagtttgttgagagttattatgagtattgattttgccaagtgctttttctgcatctattgatatgtgcatgtgatatctattgatatgtgcatatgagcctcctggtcatcatcccaggcttagctcacaaaagttgtgagcagggaggccaccaggaatgtggggcaggtattatgcttcccattttacagaaagtaatgccagaagaaaacagtgcacagttactgctggttcccaatagttgatttgactcctttaaagatttagctgtcccatttatgtgctggataacatcaattgattcttaaatgttcaacaagccttgcatacctgtgataaatcccatcatggttacattttaatatacttacttttcttcatacctgtctcaagagagaaagtagctcagtggttaagactggagtcaggctgcctgggtataaattgcacctccgttgcttattagctgtatgaacttgggcaagatatttaatctctctgtgcctcagttttcacatctgtaaaattatgtcaaatagtactgatctccaagggtggttgcgtgggttaaattatacctaaagaacttagcaccccactcagcacatggtggctgccatgatggtttgccgtgacctctcttcatttgaatgtgtgcccagtgtcttgtttctctctgtattctcagtgcctggtacaaagtcgatagattttaaaagcccatagaagaaaacatacatttttccctgtttgtgggtatgtatggaagattctgtaactttgactagacacttgatattcagataaaatagccctaaagaaggttctcaagggggtggattttctcagactattgtgagcatagttcctaaagctgactctatgtcttgtgctgactctaatcccctcctggccatcatcccaggcttagctcacaaaagctgtgagcagggaggccaccagggatgtggggcaggtaatatgcttcccattatacagaaagtaatgccagaagaaaacagtgcacagttgctgctggttcccaatagttgatttgactcctttaaagatttagcacctgagttagaatccggatggcagaacttctctattggaacctagtcccactattcctctctcccttcattcaacactgggtttagaatgcttgccagcagcattgtggaaattacctcaaaggtagaaacacgtaactcataagcacacatgaataggtataggtcataatcctggaaagacggccttgccattgagaggggaatagcaggagcaaggctacggaagcacgggactctggttgagtctaggcactgtctgcatgtacttggcacattccttaaaaatggcagcaagcagtccattctcaaatggaaattggaacaaaaaataacgtaaaaccataaataacagaaaagaatatatactcaaacatgtataatccatatgcatgaacataactcccctattgggaatttctcataaagaatccccccaaaatataataccacgtccacaagaacccacccacaggccaggtactgtgcgaggcactggaatacaatgggggtaacatggactaggagactcatgaaaacgtcatgacaaacacctgggaaattctgaacgttaaatagtagggaagggtttctccaccatggcatggtggccactttgggcaggaagattgtggtgaggctatcctgtgcatggcaggatgtccagaagcatccctggcctctacccactagaggccattggaagccccatcctcactgtgaaatccaaaaatgtctccagacattgtcaagtgtctcctggagggaaaggggggaaagtgactccccattgagaaccactgctttaggggaatacttaagaagttgaggcatatctgctcactggaaaatggaaatgagctaatttggaggcttaaaacagcagcactgggaaaatgacataaattttaaaaagcagaaagtaatactgcatttattctgtggtttggctgaggttttgggtttcagaggaagctgctgagaaaagagagggagggaaaatgtgacccagaaatcacgggaaccagggaatctcaacaaattgagtatcttggtttgtgtaagattaggaacctggagataaatatgggtcaggcagatgcaagtaaaatgatcacacgtggggagcatggaaattgggtcttaaaagtgagttaagtcaagggtggtatttaaaatatgtcatatgtaaatatgacagagaaaccaccaatcaaaacagccatctgctgaaaccacccactatgggcgttcctgtgcctgccggggcgtgcggggaaacccaagagggagcaccagttggtgaacgtcagtcaatccacaaaccatctaacagaggcacagggattaaattcagagcaagacctggcaaaacagaaacagcccgaggccagagatgaagtgaaagaaagatgacaacctagggcccaggagggaagcttccagaaggttgagttatatttaagccctttcactgtatacctgggaccaaagaccctagagcagcttcagacataaattatgtatatacatgaacaaagacagaaagggagcaaagaaaaatgaaaacagcttgatttgtagggctttcagcatggcgggtggttttctttcccccctcgttttatttagacgtctgctgctgctgcttcaattttgttccggcaatacaagtaaaatatatgtggatgttaacaaagatgtaaagagccttttgaagtatataactgattataatttaacattcattaagtttcttttatcaaaaaaaaaaaactattaagttcattgaagaagtcataaaaacaaaccaaacacccaccaccttctcccctcctggggacatggcagtggccacttcaaagtgggtcaggtctccgtgaaggaaaggggctcttgagagagtgatggtggcccaggggccggtgtgatgtttcatgctggagggatacagctgtccgtttcctttgcctcttttcatcctgatggagcaaacggctcattgtttacgctgacctagtgaggttggcttcaagctctcccctcaccatgttgtaatgagatagtcctgaggacacacgctctgtccattgaaacagattagctctgatcacagcttaattatgtgaagtacagccaaaccctatttatgcttttcctagggatggggtggaacagataggaacgggtaattgacagacattaagaaatagacttaaatattgtttgtcctgctttagtacgcacgatattaatgagatgttattgtgagtgctgagtaaagaggttgctgccggctggttctcatgccaggcagccagcagaccttcttcccaagcagggaattagcgcaggtgttcccttggtgaaagcctggctatcagcatcaacaccttctagaagatccgtgcctcttggtttatttcagggagcctgtgcaactccaaaaggatggatgctggatgcatatggaggttccatgccttaaggctagcttacaaatgtatgaactcgtctgtcttttattccatcagaaatgaatgtacattgtaggaaccagacttagcagagaacacggagtattgggggaaacctcaattagggaataaagagctagtacacacacagatgtgtgtcacatcagactatgtaatggacacaatttaggaacaactaaggtatgtcctgtaattaggggacttgttaaatctgcactgtctaatatagtagccactagttacatgtgactgtttacatttcatttaatcaaattaaagaaaattgaaaattcagtgtcttgatcacaggagaggaattttaagggctcctttgtcacaggcggctagtggttctcatgtgcagatgtaggacatccccgccatcacagagggatttgctggacaccactgagtcaaataaatggtagtatgtccatagaatggagtattctccatattctcaatgaagtaaatgcagatattctggcatagaaaggtcacccttgtgtattgccaggtaaacaagttacaaaactttatgatattaatttcacttaaaaaacagatgcaacacacaggcacatactttttggataagagtgcaaaaaacacagaaaggatgcacaccaaattgtcggcattagttaccttgaggaggcgggggtagatgtttactttttattttcttcacatgtgtattgtctgaacatatttcaatgagcatgtgttactgttgtaattaaaaagagatttatgtgatgaaaactgatgaaaatgattgagaaacatgaacagagggttttctctttgcctctttagagactggttaatggtgctacctgagtgagattgaccagatggcttgttgggagaagaagggagctggtttggagtaaatccatccccaccactatcaggtcttgcccaggcataccctgcttttcctgaatgtcctgaatgttgttgtaggacaacaaatgcgctttataattattcataggacctctcactactaatctttgagtcgataacagcttctgctatagaagggggcagatcactgggcttaaatgtcaaatagcgcctgagaggcttaaacaaccaccagtatgtgtccctctgggagggcttctctgccatttagaagatcaatgagaagatgtcctccaggccagtgtgaggtggtagaggtgtgtgcttgcgtgggcatgcctgtgtgtctggtacccttacccactgaaacagcaaaggacatgccttctcccatatgacaaatcggtacattgatgatttcgagttaaaaacattggataaattgcagtttcagaaagggctagctgacttgtctcttcctacatgtagcaggccagaaagattcctctctgggaggggcatcctccccctgccagggcaagaaaatagcccttatcgccagagactgcggattgcaggctgcagtgggcttgaataaatacccttactgaagtggcccttagcctccactaggttttttgtttgtttgtttgtttgttttgagagggagtttcgctgttgttgccctggctggagtgcaatggcgcgatctcggctcaccgcaacctctgcctcctaggttcaagcgattctcttgcctcagcctctggagtagctgggattacaggcatgcagcaccaggcccggctaattttgtatttttagtatagatgggtttctccatgttgttcaggctggtcttgaactcccgacctcagataatccacacgcctcggcctcccaaaatgctgggattacaggcatgagccaccatgcccagccaccgccactcattttacacagtcccctgtatgtctcctagtgactcccctagaaattcactgaccctagccagatcccatttgtcctgtctttgtcagatttatcattctttgtctaaaaagttcaaaagcatcttgctttggccgcttcttcagacatcactctcttgtgaagatcccttgtacctggaaaactattaagatccgtatgcttttttcctgttgatctggttgtctgattcgtgtccatttggtttctaggtccagccaaagagcccacataagaaccaaggtggggttgggggtgatctctggtcccctttgtgatcctcttctaggagatttacctctctgctagcttacatactatgtgaatatagcgtgggctttcttcttgctcttcagaaagtcttctctaccctccctcctcctaccatggcgcattctgcagcatgacaggcattccactctgaggtgtgagccatgtgggctctcaggactcttttggctccacttctgcctttgtagctgtggaccacgaggcagtgactttgaaattcagtcttattctgcggaaatattacttactcgtccctacctcatagggtggtttttcgaagtcagtgagacaaggacagtgaagggttgaggcagtgctcagcacatagtaagcgctaaataaatgttagcttttgttgaaattaatcttacttttcactaaattgtgctgcaaagcaacgtgccattgcctgttcttcacatggctgtgtctctcctcctcagatggatggagtaggagggttgttggaagacaaaagcatcctgcttcactcttgtctctccaggctcctgacagtgatttgcactagctgattagtaaattcatggcagtgcctggtgcctgagagagcgagggttgggtgcagcttggctacagctctgaacacagcagtgggggctcagttgcttggaaaagctgccagccagtgagcccagcacagtcagagtcctgtcaatgcagtaggtgggtaaaataagacaccagtgtgcctttgaagcatgactttctgagggagaaggctgggagcctttacatttgatgactgggagaaaggacccaagtttttcctgtgtgtttccttaaaacagccttattctctagatgtgatttgttttctgttttattttcaaagagaagaaaatcttgttaatacttgcttattaactaacaatttcactttactggtttggtatgtaaaactgagggttttcttctacccagtggcagtttttgatatgaaacagtaacaacaacatcaacgtaacttgtatttttgaatatatttgatacagatattggttaaaagcattttgtacatatatattcttacatatttgtgggtatgtatgaatacatgtatatatgcatatatatgtgtgtgtgtaattgattctcattattcatgaattctgtctttgtgaatttgcctactcagtaaaatgtatctgtagctcccaaatcagtggtcatggtagtgttgtggtcacttgcagacatatacagagctgtgacaaatttgaatcatatgatgtatatgcttccaggtgcattcaaactaggtgagactgccttcttgttttagctttcatactacaaacaaatatccttttcatgaaccatttaatgccacatttgccacaattttatgctatttcttggcaattttgctgtcaaaatggccccaagtggactgcagagtgctctctagtgtctctaagtgcaagaaggctgtgatgtgtctgactgagaaaatgcatgtgttagataagctttgttccagcatgagttacagtgctgctggctgtgataaattttaagtaaggcatctttaaaccgaggcgcacgtaaaacaaggttatatattgactagttgactgaactgtgaccagaggctcacaggaacctaaccctgcatttctactaggagcaatggttcaatatatgttaagtattcatggtgacttcatagaacataagtaccataaataagagaatcaattgtatgcagacactccttgatttatgatgagattttatcctgataaaccatcctacatcaaaaaggcggctgcatgcctacctcaaacatcacaggtactctgcttcaccttcctcaactatgtcatgcctcaactctgcttggactctgcccaactccagacagggacaatgtgacagtagccagctcctctctgaactgacaccctgtaaattggacctactgaacagcaatagtttagcctaacctactttatatgtgcttagagcacttgcgttagcctacaggagggcaaaatcattgaatacaaagcccattttataatgaagtgttgactgtctcatataagagtattgtaccacatatttctggaccaggaaaagatcaaaattcaaaatctgaaaaatggtttcaatggagtaagtatttcttttgtaccattgtaaagttgaaaaactgttgtctagtcattctaagtcagggaatatctgtgtataaatcgtgtaaaatcctcccagaacctttatgagagggtgtggactgtgattcttaagttaatggcatccctctctgcctataacgatctcacgtctgtttttttgccaaaaaatatagctgctggggaacctgttcagggaagttgggatgtgtttatccttaggtgtttattcatctttccaagctcctgcaatcaaccagaaacacaggggaatggaaggcttagtgtttgttgtaccaattatgccacaggcagtatcttgtgtattttaagtaacagcactgctttggtaaggcagttgatcctactttcaaaggcaaggtacctgaatcatggacaatgaggccaccatcagccctccctctccaatcaatggatgaccatacactgtgcttgttccttccacatggagacccatacttgaatacttggtgggtaccttgagctaacctctcactttgtgtggaataggcagtgggctataaggggaaagcacacactttgaagccagactcacttgcattggaatctgggatgtctgacataacaacaactactactatttttttggccatttactataacctagtcgtaggttaaccatacaacaaccatggtaactgaggcacgaagaacatctttcttatttgtggtgcatatcacaatgtaaaggtagtcctgttgatacacccatttttagaaatgttaaatggtgtgctcaaggtcacacagatggaagctggtgaatccagaatttaaaagtagaacatttaatcccagagccagcctgccttcccaccatccaaacgatgctatgccacatcttgaagaatcagaaccaccttgtcaagatgggtgacaattacaacagagaaatgatgtaaaatgcagtgtgtagtttctgcccctgagatgagttcaggaatgggtccagttcctgttcttaaacacgctttgccctactgcttgcaagccaactcggagccttctgatgtttctctccaaactgacaaaggaatcagctgttccttctagagggggaatactttgacttgtgtcttcagaagttatctgatgccagcttattcacatcgcctcacctcctagcagctggagcaggaatgcagcagtagggtattgaaatttaagaggttggccttgagtcactgacttagctgggtatcccataaagcagagagcttatacatttctatcgtattagggagacaattccagagagtgagagtgaaggaagaggggattgaggcaggtaaggaggggaggcttgcgaaggcgcgtactgagctggccatccccaagtgcaactgattgagaggtttgtagagctttgtccctgagaagcctgcctcaccaggatgtggtgtggggagatgaaataattcctccactcattcccatctgctattggccatatgttggctcaaggggcgttcctttccttgcaccgtaggattgtgcatgtatgatggggctcctctaccgagttaagaaggaagcccttggcaagggcggagaggctctcagttcagagaggagttgtctgatgtcacgttgcccctatctgaagttggacagagcccaggcagagctgagatgtgacgtgagtgaggaaggcgaagcagtgcacccatgatgtttggtgcagtcttgaaagcgcagtcactatggagccgccccccgcctctccccttctgagccgccacagctcacgcttgctttctatgtcctgagcttttctgtacctctgtcttgctatgtcaggcattcatggctgtgctgttagggagccttttcaatcttctcatgctccagtttcaaagctgtctcaaaatgagataagttaaagcctaatacagttttttagaaacacctgtatttgtcacgctgacctaatattaacacaggttctcgtctctacttgaatgttacgcatctatcgcgacaccattaccaggactgcgctctgaatctttagagattatctgtgtgcctgatgtcatgaataccaagtagatgatgtaggatggctataccctgccagggagacctgcctggggtaccagtgagtttacaaagacttgcaggaggcagcatacagaccatgggcttgtagctttccagttcaactacaccaccaaaccctggcacctaagactttggttgttccccgtgtcctatgagccctgatcacaaggtgagcaatgccttctaggctgggaaggcagagttggcaagaactgccaaccccagggatggcatcaggcccgctgataattaaagggtgcctaggacatattgcctaagctgttattggttctagaggactcgacttcattccatgaggggtaaaataagtagatagggaggcattcagagcctgaactggtaaaggggggacagttataatattaccccaaagctacagctcagggaaaaccattagggcaatgtttttttgttgttgttgtttcttccttaagaagggatctgtgctatgtactttagcatcacctgagatggtgtgaacaatgataagagtttgaggccctgtcttttatctacagattcagcattccttggggtaaggtctgggagtctgtgttttggcaagagttctgagtgattctgatgtacactaaagtttgggaatgactgtcgtaggagtgttcagtaacttgggcctcctggaatgctctaagttgtgtcacagcccagctgagtacctgggacagaacagggaaaagcaaggagtgacgatgtcagagaggggctgtgagcccctggctttggagccagacctgtaccttcctggacttcagcaagttccagaatttctgtgcatgtgagtttacccctgtgtaaagtgaagatgacaacagggctggctgttattctagggggctgccccggtgtacctggcacagtgcagtcctgctgattttcatattgctctcattgccatccacatccgagggagtaaattagcgggatccacaagccacggatgagccttgaaccagagaagccacaaactagcatttaggacttcctgaggctcaggtatgagcaatgctgcccaagtgcatggcatgaaacccactacagaccatcggaaacctcttgaggacaccattcctctctggtagcctttggggcatcattgaacattgggtcagcatgttagatacgatgaagttccagatccaaggacaagccctttagatgcctagtatatggctctgccctggcatttaacgcccaggagattatattaccctatcaagcttatagaaaatggacgcaggtacaatatatcttatctactgccacattgataaagtctacagagaaaatagtgggtcttttaggacttacccattgagccttttattttaagtgacacattctagtacggacttaattgtaattctgataacattacttgtaatactgtctccagtccttggaattaatttgactggaaaaaatccagaaggacttaaatgtttctcattaaaagcattatagataacttattagacattgtgactaattgtagtatggcccaatgtaaagccatcccaattaagatgctgtttcttctcttgtgattagttggcaaaccttttccatacaactgtgccctctagaatgtagatcaattaagcatatataattggacggaaccatttgctccccagttatcaccctctccagtgagatataccccagccgggttggtaggcttgtgaagacaaatgtcctgatctcactttagggagttgacaaatggatctctataaggcagcttatgtgctaaatatttctcctggccccattggcagagatgtagtctgttttcccagtacagagaatttcttgcagcctgtacattttccctttaaaagataaagagaaaccattatgcagtttttattcctgacctgcctcaaggagcagatacggactggaaagcagcccctgttggataattgctgcttgtctcagagtttgagattctgccggggtttcttgagtcaccgagcatatggggcttcaggttggactgcccactccagtgcctgagaatttactgggaagttttaataaagtagagcagaaattttccagctgcatccgaaatatttgatgtcatgctgaattgcaaatccctagtcggaacatttgaacatcatctagagggatcaggaaataacccaaaggtttggtaggcgacttagaacaatggctgctcttaagagggaacaatttagagcgatttctttcctcttccttctctccaccttccccactgatttctccttcacgcacctatgggtgtgaaatgagaaaaaaatatcacttgaaaccaaatcaaaagctacagcaattctggaattaataaaagctcacatgtagaaggaagtgtgggtttatgggtagggtgaccatgcactacccaggtttgctttacctgaaggcagcggggcacacgtactgaggactattgggtagaaggacagatggggctataattaggggatgagcttccaacagattctcggaatgagctaggcatttgcaatgttcagagtatatagactggcacgtaatttggggtagtcgggtatgaaacttatagacacatccatggatttccctttaataaatcgtctcttctagtagtcatttgtcatcaacgagcaattcagtaaaagttggaattgagcataatgttgcatatcatttcagaacatctggccctaatatgtagtaacagctgtttagtacctgagatataaacaaaacatttttcccatggctgtcactgttcctcctcctggaggtgcagtatcaccgaggcttctctgtatttcctatcatgggtaatagtaacaatatcaataacacaatgatgattatcatgtattgtttaactatgtgtcatacactatgtcaagcacttttcatatatgatcttggtaaatcctcatgccagcctttcgtgggtattagatggcgaggggaaagtcatcaagccagagactgactactttgaaaattgaatacaagtctgtgcagtgctacagctaacattctttaagtactaaaataaattgcttgtaaataaagtaaatgaaaaaagaacacaactgtgtaagtcacaaatgaagaaggcaacaaaagggaacccagaagggttttttattttttggtgtggtcttcctttgtttgggatgtaagacactgattttcctgctatattatagtatgtacactgttacgaggtggcagtgcagtaccttggtcatgtaagccaatcaacaagacttgttcttttcctgatgttcaagggagtaattccttaagcaaaatcacatttatacacatgtcttttcaaatttttaaccaaatatttcaaaatcagttgtttaagaaaacgattacacctataccttcaatatcaaagcagatcaatttttaaaacaaatttactaacctagtcttcagatacataggtttgtttttctcactaatcctttgtggtcactgaaagagcataggccaccccagtcttttgcccagatagtgatgaaaatgctgatcttcgtgaatccaactgaaattttaacttcgtgcccaagctgttctagaactcaatttatcagatccagatttggtattctaaagactagagtgttttactttctgggtgttctttgggcttcttttctattcatgaccctttggattataaaagaagagaaacaccatggggcagatatgtccaagaataaagaaaagagaaagttgcgcacctgagaagtgccccctgctggccagcatcatttctctgtgtctcactacagaaggaggtctttgtttatgaattctgccctccccctcttgccctgagactatcacctgctttggaaagaatggcatcatttccagaatgcccctaggggcattagcttctcttctacactctctctcttgcttttcaatatggaagttaacaacgcagtctttgaagctgggccgattggatttcaaattctaactcagtaacttcccaactgtgagtttgagcaaggtatacctcttaaggctcagtgttttaatctgtaaaacaggaataaaatagaaataataacaataactatctcatggggttattataagagtcaactgatataatgtatgcacaccattgagcagtgtgtcttcctcattattactccttgatagatagctagaattactgagcatccgacttagaagtctaattctctattttgattttattcctaaactcccatgtatgcaccaccaccttaaactcggtacatctatctaggccgtgatgacccctctactggcagctttagtccctccctaatcactgtatttctatcattgatattaatattcttgaaatcacccggattcgaaacgtccagtatcattcttggctcttccctccactcttctctgatcctttcgcaccatatcatcccctactgcttccccacacctctatctaggtgatcagtcaccaactcctattatttcctcctccatctgccttgtaaatcttaattccattctcctcactgattcactgttctccatagaattccttgtgactttcttggaggtggggatctcatgtttcctttaagaaaggaaatatatatgtgtacacacacacacacacacacacacacacacacatacacacacacacacaaaatatatatatttggagacagagcctcactgtgttgcccaggctggagtgcagtgacatgatcatgactcactgccacttctacctcctgggctcaaatcttccttctgcctcagcctcctgagcagctgggaccgcaggattgcgtgccaccatgtatggctaatttttataaagttttcttttttttttttttttttttgtagagatgatggggtcttcctgtgttgcccaggctggtctcgaactcctgggctcaagcaatctttccaccttggccttacagaatgctgggattataggcatcagtcactgtgcccagccccaggaaacatgttttatttcttgtgcccccatcagtgttcgacgaagccccgggtaggaatttggtagatgcaggtgtttgattaatttccccttccttttgtttctcttctcagccgtgtgtctctttcctctgtcattcattcaaccattcattcattcattcaataaacacttactgaggttcacactcagtcaaggaactgagaacactaatgccattactagttctctctagaaactcactagcaggaaataaaagtatccccaaggagaaagccttgggaattaaaattttttgcacaacaaacgtttattgagcactgactgtggcactttgctttttagtgatgaacaagatggacacaaccccagccctggtggagcttaaaacctcacaggtattagatgagcatgagataaataattctacgagccatgaaagtcatgaaagggagaatgcaacagcacaacaaaaaggttttcatttctgagatggcgagagcctccctaaagaaatcatatttaaacctatgttgagaaatcgagtatagtttagttaaacctgtatatgttgagggcaggaggcagagtgttcacattagagtgggcagagaatgattgctccacaactttacaggcatgggttcttgacatatgcatacaagctcatccatgtggaagtgttagcaacagaggcaactgtatgggcagcaactccaggtcctcaaaaactgagaaaactaaaattctatccaggtccggcaatgtgtgctttctgcatctttagtatgtgagttggtttagtttgttaattaagcctatggaacaaaagtgttctttctcctccagactttcaaaggatgtactctagggctcgaagaaggggaacagagctgattatgttggtcctgttgtttgtgtttttcttcccatttaagaacgtacatttgaaggtgcagtcttgaaattcttgatatggatggcagacacttgtaatgagagaggaattagcagaaaatcacacctcatttcaataaatcttcaccccttaaggcagcctggtgcccttcctgcattggcctatggaagtcaccatctggactgggaggattgatgacttcagtttcacccctttctaaatagtgtttatgaagatccctttcttcaggtcagactagagattgtacctacaaataatattgtaattggaccacttagttttcatctttgatttgaggtatttgaaatgaatgtgagattaaagcaaatgaaggggcatgagaagtgttagcaatcctccagacagggaaaatttcttttcattctgtctccatgatatcaaactgaaatcctcagttaaccacagcaggggcaagtgcctgagttgaaaatgtcttcatccttgtattcttaattcatcacctgagaagtccttggatcaggtacgtgaaaccagaagagagatctccctggggatttcatagatggtggatatttaaatatgcaaaacattattgagaaatatgagatgtgtcagccatctcctgtgctaacattttttccaagtcaattactttgtggatgtttgaggtgggggcacactggaaagaaagaaagaaagacaggaggaactaaattatttataattatggtatgtgttggcgggacgggggctgccttctgagacacaaatggatgacaaagaataagttatctctttatagatagaatgtggcaataattgcattgtctctggattcaaaaagtcataatctattaatttgatggatatcaaaaagctataatctgtcaatcaggtgtcagaagaaagagtctctcaaagctttgaagcatggcatttagaatacccctggatacctttatttctattctaatattaataggaaggaaggatacaaacatttttggcatagttagggaatggatatcattttagctgtcttaataattttgcaacttaaaaatcgtattggataagggtgccgtattgaaaaaaatgtgtaaaagacacactacagtgaattagagggagataatttcatcctaagatttctctgacattaggcattgtggcatcgctttcttggtttaaatgtgaaatagaacctgagattatttttcataaatttatctagcccatctattatttctctatattatatggctgtatacttgaaacataccaatggggactgaagaaaatgcttaagtctataaatggaatgtcaaactgatggaaggaggaaattggagatgtcacacacagtaaaaacacagcttttccaggacccagtaagcttgccattaccaaggaattaaggtattctcctctggtaggaaaagaatttgactccttggcccagcacagtttcaaagctgcatgaagtcacgtttgcctcattacaattcctttggttaaagatgcttttctaagtacttcagaaaatgtatgcaaaaatattttttggtgcggaggccaccaaacctgctggactcacgttcctgcttttggcaagcaaagcaaaagaaccttctgggttcccttcctgcctttcctactgagatcaagctgaaggtggaatttttctatatatccagtccagcctttgtgacctctgcctttaacacaaacaccttgtttaaaaagtagacttgagggagggcacttgagttcagaagccaaaagaaatgggtattgctctttccgcgctaagcagttctgaacctagaccatatccttgggagaccagagcagctgtaagcagcaaactgcctcttttctgcctccctgtgaacctgcttccctggagggtatgctcaaactcaattccctgttttattgttcaaaggacagggaagaaaggagggagaaaagattgattaagcccccagtctgtgcctggcaacattctaggtgctttgtatctgaaaatctattttattttcacaatgatctcatccatgtccatggattcaactttatctacctgaccaccaataattcatatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccagtttttcccctttctcacagtcaattaaaattctgttgattttgtctgctaaatatctcagcaagaatccatccagttctctccctctccattgccagtatcctaatctgagctaccatcatttctttttttttttttttttttttgccttgaatatcaatctggccccccagatggtcataccacaatcactcttaccttcttccaatctttctcttctccccaaccagaatgattctttgaaagcttcagtatgatgcatatgacgatgtcattcatttgatcaaaatccttcagtggcctgccgttggttttttttatgaaatataaaacaaaacctcggacatgagctataagaccttgcatgagatgcactttctgagaccagcccctccattctcctttcatgccactctacactttcaactccagccaccccagtccttgttaagttgctgagactatcatgcacaaaggtatttacacagttttgttttgggtttctttgttttttgttttgttttgttttgttttgtttttttcaacggagtctcactctgtcaccaggctagagtgcagtggcgcaagctcagctcgctgcaacctccgcctcccaggttcaagcgattctcctgcctcagcctctcaagtagctgggactacaggcacctgccaccacagccagctaatttttgtatttttagtagagacggggtttcgccatgttggccaggatgatcttgatctcttgacctcatgatccaccctccttggcctcccaaagtggtggaattataggagtgagccactgcgcctggcctacacagtttttatgcatattgctctctgtacggagaaaggtaatgcagactcattcatcctttgtatttcaggtctattgccacttctttgggaaacatcacccctcagtctagatctgatacccctcttattccctcttctgttttatacctcttcttcctagcccaggtgtttacaattcccatttatttatggggaatatgtgattattgtattttccctactgagattcaaagctatacaaaggaaaggactcttctgcctttttttttttttttttggtttttaactcattatgaaatccccactgctgagcacaatgctgaacacctttgaagtaattaataaataacgactaaattactgctgtgtagataaggcagataggattaggttctttcaacagtgaggaaatcagagctcattctaacttaagggtttagaagtatcagaggcaggactctgacccgggtctccagactcacaaaacacaatacactataaggtgtacaatagcactgacagatattttttaaaggttcctctcatctcactatactaacacaaatgttttcagttctacaatctacatttccccctccaatttttctcctcttttttgactgccttgatggtttcagtgggtcctggttaagcctgtctttaagtttctaatcaaactaatccaagtgaatttggcttctgaccttgctctcacatatttgccatctctaaatgattgatgtctgcttgatccctgttggaaaagcgtctgaagatatgatccagaaaatctatagttgcaaatctagcataattttaatgaatcgtggtcagaatagtaagaagcattgcacagaaggcttgcataaaaaatatgcatcttctgtcatcttcaccctctacactggcctcccaagtccccatggaaggtatctagtacgggaaactttcttttcctgtaagaatgttgtggccaaacatgctgtgtattggatggatggatgggaggatgatttatattttcatctcggtatagttcataggtctaggatcagaaataaactagaataaatataaatattgcttttcttaacgttggtttaaaatgcaaatgcatggcatacagaaaaaactttttttttttttttagctctgaaagctcaatttttactacatgatttccctagtagaagtactttttgcagggtataagaattttctgtttgcttatctgttttcagtctagaatgttcacttcttaagggcaaggaataggttatgtttaccttcttatctctggagacttgtataatcctagctggtcctaagtactcaaaagttttcttgaatgaaacaaagccttctccggatgaggaagcttgtcagaagcttgagtgactggtaaggagggtgaatctctgctgctgatttactaagaaatatttggatctttccttgaagctaagggtatatacctacttctgtgcaaaacaggtggcatggctggcccttgaagagtacacagtttaaggagacagtaatgggtacagttatcttcttaaagatctgggccactttgttcctgaaaaagtgtgggaagtttctctcttaggcagtctatctcttagagcccagtactcacagcaaaatatttataaaagaaaacaactctttcatcatccctgacatagcctgccctcagcctagaaagaaaaggccaataattgggactgtgtggttccaggagataggacagaaggatagggccaattcaacaggtaagaaagacagcacactcaagggagcagactccagttgatcaccgctgtgggcagctgaggcacactcctcccaagacagctatagaaagtgcctcagaaatgtctgtctctaggacacggttcccattatccatgggtcaaagcttgcccgaggaacgccagctcctttgcattcccaaactttgcaagcatgtgtcatcctgcaggttctcttgggtattccattgtaaggagtctgagaagctccaaggaagaatgcagaaatacggggtatagctgaggccaggtgctgtctgatcatatacctgggaagctgttgttgatcacgtacctgggaagctgtctgatcacatacctgggaacctggttgttatatccatggctggggagcagggtagcagggagcaagaactgtccaacataatctagtttacctatggactttcaaaggtttgcaaagatttacctcctactaaaatggcttgtgagcatggaaggcttaaacattagcagagcaggtagaaaaataacgcctggtaagatgccaaatggtggaaaccgaggcagaagatagtcctctggacaaggtcagcataatctagtacatatgaactcactcacgctcctgcatcagactcccctggttttggaatctgtctctgttgcttcccagtggaacctgagaacattgtttaatcagccttggttatgtattcgtcgtcagataaatagggacgttaataccaacctcatactgtttagattttggatcatttacaatgagaatgtgttcatctgttacctgtgtaactgaacataataatactatgtttgaacagatttcaaaaatgggtttggatctgattttaaaacatttgaaacagatgtggaacaagtttttaaagaaggaaccctatctcataagattgtcaggatcattaaacatcacgagtatgagcccacaggaaaccttcagtatatcgtgatcttcttgacggtggtgaagaaggacaaggaagaccaccaccataacacacgggtcttctttggaatggaggttccaggatctatggggaatttgcttgtccctatccactctcatccctccactggggaagagagagttggtgccagtcttccagcgtaggtcattgttggctcagcatctgggaagaatctgggcctgcaggaaggactcctggacagtgccatgagcagctgataaagaccaagagaggggaatgtggggcctggtctaatgagagttactgccataactggcatttactgagcacatcctacatgtgactctgttctaagtactttctgcatgtcgtgtgttagacatcaagagtcgaggcaccctcattcacattctacacatcatgaaactgagacttgtagaggttaggtagtttggccctcatcacagtgccaggaggtgcgggtgtaagatttgaacccaggaagtgtgattcttgtagcaattgctgtgtggttgagatctggtctgggaagtggggctaacacagaagtgtggataggacagattatttctgcgctccaaagttatgaatatatatactccaaaatatgcttcagtgactgagtgagacataaatgggttactctgtcagtgatcattatattactccccatccctgcatgcatgttagaaaggcacacacaagctggaataatatgaatgacatttaatagactacttacaaaaatgttggaagatctggggaaaactaacgaaggaactttccgtacttgaggcctatcaatagcaggaagttattactacctctaggcctgaaagggcaaggagaagggggccaatggaaccaggagatagaaggctggtggagaggaccgcctaacctgggtggtggccataaagcgagggagctggagagaaaaagacaccttaaactcacttgctcagtagctcccatgagccaaatctagtggaaagccagagaagaaagtgagaagagaagggagcccataaagaagacaggactgcctacaaaggccagtgtctcagagcacaaatgaggatgcagatgagagcaggtctgttctggcatggcaaaggggcttgcccagcactatcagcaatctgcaaaaagatattcttgggaagactctggtgtctgaaagattaaagggaaaatgcatccacgtgataaaatattattcagccagaagaaggaatgaagtactcttacatgcaataacagggatgaaccttgaaaacctgatgccggtggcaacgaccccataccgtgtggttccatttagatgaaatgtccagaataggcaattccatggacacagacagtagattcgtgattgccaggggcgtggaggaggagggaatgggaagtggctgctactgggtacaggatttccatttggggaggtggaaacgttgtgaagctagatagtggtgatggttgcacagcattgatagtgttccagatgtcattaatggccaattttatgttatgtttgttttctgacaattaaataagcaaatacataaatgagaaagaatttttctctcataatgtttgtttgcctcttactcattttctgagctagtcaccaaaacgtatctgacactttcttgcttaacctggcgggagtggtagcggatgctcctggtgcccccgttgcattccctcacctttctgccagctcagcttccagtagccagcgcctgcctgtgtttctctgcctgagggctctctccggctgccaaagcccgtgtccacgcacagcagtaccagagaattaccaggtcccaggagcagcactcgggtgaggactgacatgcgtcaatgtgtaaacaccaacttccctgcactccaggtggggtccagagctcagtgcgtcttgctggctcccagaggccccagcccggttgagctccagttgcctgcagcagttcccaggcttagtgcacttgactgtgctgccacctctcctttcatttcccctcttccctcctggtttctccttcaccttccaaatcaggtggggctctcaagcccttggctcaggatttataataactacggagtaataatagataacatgtattgaatttttattgttaaaatgtgtatgagaagacactggcttgtgttcattttgcctctcttgttcccaatgataagactgccttcacgcatcaggcaaataactataattggttcctggacattagcataaacagaatcccctagggaaagtgctaaaagtgcagattcccaggccccacccatcaacatgctgattccatctgtctaggtgtgagccttggaatctgcatttatcaagcttttctggttcttctaatgcagaatagagtagaaagttttcattgaaaaacactggacactggcatgatgagaaacagaggagaggccacctattggaggcaggcactggcatctggtcagtatttcaacaaatgtggtccctcaagttctgcagggagaaatactccattacatgtatacatttactttctcttaaactgatgggatccatatccaagtatgaaagttaatttcggtatttaataatcattaagtaaagagagagtgaaatatctacactatgtaattacataaaacatgcttctggcaatatttgccccctaggaaattcaaataggaagtctccaaggagcaaggttgtattcttggaggtggacacaaagtaattgagctttgctaatggagataattaattaggaaacggatgtgcttgcttctgagaaaaatattggaaagatcttctgagaaggcctagccctctgctcttgtaattttccgaagtctgtgccaccctgaggactggtgcttcccctgagccatgacccagccacagttaggaattaagggagcagaaaacacacagccattgcccacagttcaggctggtcctaagaatgcctgggccctaggaacacactatctccaggaagcagctctgaattagacctcgggttcaagttccagcccccacttatcagctttctgaacttagccaagttattcagtttccatggagcttagtgttctcagcttaaaactaggggttgtaatagcagaaacagtcatcagtatccagtgaaacaatgctctgcaggaaaataagtcgtagatcagaagatgtcgccctggtgtggtcttactaaaccttccctgtctcagcccggggtcttgtttattgcatctgggttacctgtttgcccctttctgtccaggtttgatctgcaggaacctagccttctggtctaacctttctagcttgtctgcttatcaccccaacctccccgctttctggttccagatgctagcctgttcttgccttgtatatctgacttgctgagctcactcttggtgctgcaaagtggccatgccatgaatcttccatagcccgatgcaatgtcaccccagtgacacggaaggatggccgtatggtgagagactgcattcagaccactgagccttctcttccctaattatatcatgccagaaacagctagaccaaggagtcaagcacacaaatatagttggaccagaaggaccagcagctctcaaggggtaagagaataaggaatcatgtgagcattcatggattgaggaatgcatccattattcaagcaagttgatagagataattaattaggaaatggttgtcttactgtcctattcaccaagctatccacaccatctagctcagtccatactttcttaatgagggagaaaatgagactcaagccaagaaggcaaagacttgatgtggatgatattttttctatttttgctttctggtgatggtagacattatattacatattattaggttaaggtaccgatggttttgttttctgtgttgataaaaattgtgcgctttttattcttttacagaactaataaaaacatgacacattaacctttgacttgtctagtctcctcttttattaaatctgctctaagcagttggatggggagtgccttttcgcctgtctaccccttcccaaggactatttatattgaggcaaccaaatgatcaaggaagaattcgtgaatagccatgatcaaagtaaccagacagggagttagaggttcaatcgtatttggggaaaatggtccaatgatggggaaagggcccaggttttgacacctgaagacatccctggatttcaggaatttgaggcagatccctagagctcagatctaggattcagaacgaaacggtgactgtgagagtaaaccatggtgtctgacataagggtttccttgattaccctttaagggcccctatgaatgtctctgggtcatcagtcccttagataacatcatgtgtctacagctgggatagcaagtaggttttgttttgtgggtcaactcacatgaagaggatgcctagatgtctgcggtgagcaagattctagagctcatcaggaaagtatgctgtagtcaattagtgatgtctgccatgtgcacgggtagagaagttatgtcatgcataccacagactcaccatctcagcttaatagaccatgaagtcaggatctggggagctaccttaatgtatgaggactgtttccaaaatatttctgaaaactattgatactagatcctacctggagtctctactggttccatagcatggaactgtttacaattgcttttgatcctttttccaaatgattgagtgctttggcataaacaggtcaggtacagaaagcacggcatttgagaattatcctctgcaaacatgacttgcaggcatagcctgagcccactcagagcccatacccaagttgtgctttcttaaggccacagcctccttctgagagctgaggaagataagggtggaggacaaacaacttgggtattctttgaggaaatataaatcacatttaagtagtcgcttgaaaatgagtaaattcacctatttaatgtgtagtattcttggagctgggaaatttagccaaggtgggcaccacttgagacagtgtttgctgtggagcaacatgtgtgtctggccggtaaacctgcaataactcagtgcgcagacattgccaggcaaggcctttctgggagaaatgatccaatgaggggaaaaaatacttcagttttgttgagagatgatcttaatctgtttgagctgctatataaaaaaataccatagactaggtggcttaaaaacaatgaatgctcatttcacagttctggaggctgggatgttcaagatcaaagcgccaacagatttagtgtctggtgaggtcccgctttcctcatccatggtgccatctagccgtgtcctcacttggcagaatggatgagggatctggatggagcctcttttataagggtactaatcccattcataatggctcatcctcatgacctaatcacctcccaaaggccctgcctcctaacactatcaccttgggggttagacatttaacatatggatgttggggggaataaatctttagcctgtagcaaagataatgagatcaggtgtaggtgattaagtgacatctggagaaagaattattagctgctaagaaagatgtgtttgtgcctgtgtgtgtgcacttgcacatgtgtggatgtgtgtgtgtgcatgtgctctgtgtgtgtgctttgtacacaaggcagagtttgcagtctgtgagggggccagcaggtgttcaaccccgcctggctcaggcagctttcgcttcagttggcttttatctcttcctatgtgccctcagccctgtgtcccagggagaggtttaaccaagtctagaatgttccactctgcttagatgccacttcagaggtcttaaaacagaacctttgttttaagcagagacagtcctctttttgatacgtggttttcaggtgctccctttaggaatggccgccacccacatatcatggttcctctagtggttaaatcatgatgaataggcacagagagctgataattaaggtaggaaagagtaccatatttctcttctgcattatccctagtgaattacaattttttctcccaactgcaagtagaaatgataatcacccttagctccacttccacacccttctcagaaatttgggtaatgcatcctcatcttaattatcaaaatacagggttatcatttgcagagaacatgtgttttgtgtttgtggggtctggagagagtgatcatacaatttctaattcaaagcagaatactcttgaaagtaaatcaggactttcctgttgaaactagaacaggaagtcaccttagcagtggtagatctttgaattcgtctcctcctggttctgcggagagccatgagagactagaacacaatcaccagttaggatcaatacacttataaatgcagagggtcttagcatccatttgggtgccagcttcccttgtgtgattggttactggtgtcaacggagattgtatgggagaggaactaaagaatgcaggctcggcttttcccagaggcagcagtgcgatgcatgggtcacagaatatgccagagaacaacgaggccagtcgctcactgactatggaagatgagtccattatttaatcactctggccttcggtttttcagctctaaaaatgagaatattcctttcctcaatgattattgttatgattcccggagataacgtgcatgaaagattttagtgcaggcctttcttccttccgttgacaacccagaatgttgcttgatgcacaggggaaatagagtgatcaagaagagcctttataaatgagagttgatgttgagtaatcattttgggtattatcaatacccatggccataacacccccaccatgtggaacaacacagggaacacgacttcttactcaagctacaacaggagaattcttccttggatctctcttacacagacaacattgtctgtttttcatcaaaatgctagaaatgagagctcaacatttgtaagctcttgcttcgttcaataaagattgtgtatgggaaatccactgcttctctcccttcgtagatgtaggaatctgcctcagacattgtacaaatgggcagagaggggaatggaactgagtcttacccattacgtttaggatttcagggctgcaggtcatctgtttacctaagatggagaggccaagtcctctctcatggtagctttgaagctggtgtcagggaaaggtcagtgcctgtgaacagtgatggaaggtgtgtaaaggaggaggcagggtttagcacaaggggtaactaaatcttaacttctgggatactgggtggtggtggggttactatttccaatttatagcaagatgtaagtgatatcagctggaggacaactttactggtctatgtgggtgtattagtcggttctcaagctgctaataaagacatacctgaggcagggtagttaataaaggcaagtggtttaatggacttacagttccacatggctggggaggcctcacaatcatggcagaaggtgaaggaggagcaaagtcacatcttgcatggtgacaggcaagagagagcatgtgcaggggaactcccatgtataaaaccatcagatgtcgtgagacttattcactatcacaagaacagcatgggaaaaccctgcccccgagattcagttacctcccacccacttcctcccatgacatgtggggattattacaattcaagatgaaatgtggctggggacacagagccaagccatatcagtgggatagatatcatttggaatatggttgccttccattctgatctcattctatcaaagttggtagatcctaacatggtgacccagcaagagtctcttttcaaactggctgtcctcgggggtaggagcagagccagggcaaaccgtcagggatgctaagtaaggagcttcaaggggatccaaggcacctccttggactcagacatgcttgggaccgcgttcgtaggacaacttttactgtccattgccacaatgaaacatggcagtgacagatgtaggccctcagtgatcacagatctatatggcagcaatggttcaagtgcagaaatgacaacagtgtttgtgattttacctttttgtgaagctgggttactggggtttctgtcctggaatctctaaacaagtaaccacagggtagttgcttggctcttgcctcaagtgaaccagccaagagatctcgtccaacactggtatagcctggcagcaactgctacttccaggctgtgtctcgaatgccctgctgggctccatgtgtatctgggaacatggtttctgatctacaaatctaagcccctaaatacacaaaagcgctaaggcaaaccatatgccttaggctcacttttaaacctctctgagcttcagcttcctcagctgtaaaaagaagccatgatcacaggcatgtttatgcactaaatcaaataatgaagctcacaagttcagccctggtcatcaccattcaagactctgaagtctatcaaagcagaattcatgttctctggttgcattttccatcaatggagactcagaaatatttattgaataaaacatcaactatgacaacatattttacagtgtaatagtgaaaacatcattcatctgatgacatgcttcttttgaaccattttgggatggttctgatattgtttgtaacaagaaataaagatccgaggatgatcaagtgagcattcaattattcttaccttcatttaaaaaatatattttcaatattaaggaatttgttgttattgttatttacaaagcaataaaataaggtaagaaaaatggagaggcctgggttggtgatttggtcaccaggcagattgagaatggaaagaaaagggaacagggtaaccatgtgaccaatttgcttcttggaaaagggaccaaataggacccagagaggggcttggtcaggcttcctggtcactgccagtgctgagacattaaagatccaggccccacggagaaccagggcacctggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttctaacttgcctgcatccaaacatttttttttttttttcaagataaaaccagcctgtcaaactgtgcagttgacattacttggtaggatgcagaaaatatctgaattagaaatgggcccatacaggttccagtgggaatggctttctcagcaggtatgaatcactgctattaaaaatgtattccgtaggtaaattgttagttatcatattcatccactcttacagaaagccaatgttatcatttgggtccattattaagactatcattatcatagtcagtttagtaacctccttttacataacattggattttttgtgggttttcaagtctcttccaaactgaatctcacaatctaggtttatttttgaggccaccttgcctgaaggctcgaggatgacaggagtgacttccgtcactgccatatttcttctacacttgaagattgttttctgggatgttgctgcaaatggcaaatgtgtttgatgccctaatgtttaacataaatcaggatcatggatgtgcatagccccctcccgtttctgtaaagtattgtaaagggactcctgtcctcagagtgccaggcctcacatttacattctggacaaactgggctgtctgcttgaaagggcagataccacaggttggagcaaacatagcttctgaagaagatgtaatgcatttctgtcccagtaagttgtgcctgattaagatcttctcatagctgggggcagtggctcacgcctataatcccagcacttttggaggccaaggtgggctgatcacttgaggtcaggagttcgacaccagcctgaccaacatggtgaaacgccatctctactaaaaaaaaaaaaaaaaaaaaaaaaaaaaaaaaaaaattagccaggcatggtgttgcatgcctgtaatctcagctacttgggaggctgaggcaggagaattgcttgaacctgggaggcagaggttgcagtgagccaagattgtgctattgcactccagcctgggcaacaagaaactctgtctcaaaaaaaaaaaaaaaaaaaaaatcttctcatgaccccgggtgggtggctggggtggggttggtggagggaaataaatatgaagaagaatggtgagacaaccagtgggcatatactgtgtagactaccagaaagctttggaaatgtgtcaaccctaaagcattgctatttttaaatatttagttgtattttaatatttagctataaatgaagaacttggcttggacacaaaaataacaaaaaattaatatctaagagtcatgttctctgtggaataatcttagggctggtctgtctttacacatttattgatgatccagaagaggaagcacacaagtttgtagattagcctaagctattctggatagaaaatacacagggccctagcacagcctcgtgggcagaagagttcatctcgtgagaatgagcaaagagacacttaagaaaaaaatctgatgcccaaagcctttcatataggtgaccattgtacccacagtaatgaagcagaactactgtgctctggaagccactatgcccaccgttgttcatgaataaaagaaacatggtagatatccttatgcatgtgtgcacatgcagcacacctggcctggcacaacctgctcacacctctgggagtcacctgggtgttggctgacgcagcctggcctcggctgagctgactgtcaaccccgcaactgcctgtcccatcatggaccagaagcagagccagggatgaggatgaacgctctagttgcctgtggcagataaagaatcagtcatctagctgggaaggtaaaggttgagaggaaagccagccaatgtctataaagacacataggaaatgggagaatagagccagtgagggacatgcagagaaacacctagattttggattcatttacacattcagcaaatatttattgggcatctatggtgtaccaggcgctgcactggactcagagatataacaatcagccaaatgaacaagtctggaccttcagggaccctcgtggaggtgttacctacaagtgaggaaaggaagaccaaagtgtttgttagttagttactatgcatcaggtactgtgcacctcagaggccacctgcagtcagtctccctatatgccaatggctgccagcatcttcctgctttggggaattctcagcagccagtagcagcttgcatagcctgagcatgtggcaggtgggacttgatgcaaaatccatacccaggaaaaatcttcaagctataggggtgaaagttggtgaatgggtgtcccagcctccctgccctttggtgggacaattctgaggcctgtgccattaacttcggcagtaccttactcattaatgcaccctttactgacattttctccttctctgtctcacttactacttggggagattgtcttccaaataaactacctgtatccaggtccttcttatagatccactctggggaaaggcaagcaaagaaaatacattataagcctgttgtactattagggatggtgacttccagaagctgactgtgataacctttcctcgggcttcagaagaggctaatggagagttgaagggagaaatcaggaaagatggtctcccctcaatattctgacatgggttaataaggaggcactggttcttaaattgggatctcgatgatgctggactagcagcagcaatatcacctgagaacttgctggaaatgcaaaccctcaggctttaccgagacctcatgaatcagaaaagctgccagcaacctgtattttcacaaggcattcaggagattctgatatatgctgacagttaggaaacactcatgtaaagcatgtctatcttcccttcaattatgtttttcataatctgcaaatagttctgtcacttttaggggatatggctggacaatgaattatctgtggcttcattagaaaagtacatgaattatattgtggacagcaaagttatactgaagtgctgaagggaagtcaaatgcttaggagtgtaagctgcaggaagaaataggcagagaagctgggatagtttacccagcatggtaacttctatgttattaggctcaaatgttcacactctgcctttgaaataagtcattagaaactatattagtctgttctcaccctgcttagtaaagacatacccgaggctgggaaatttataaaggaaagaggattaattgactcacagttctgtatggtagcggaggcttcacaatcatggtggaaggcgaaagaggagcaaagtcatgttttgcatggctgcaggcaagagagcatgtgtagggaaactctcctttataaaaccatcagatctcatgagatgtattcactaccatgagaatgacatgggaaagagccacccccatgattaatttacctctctcttgttccttccatgacatgtgagaattatgggagctacaattcaagatgagatttgaatgggagcccagccagaccacatcagaaaccttctgagaggatgccttgaataggtgatatggcagtgtggtccttagcaatcagaggagagagaacgtgggttctctgtgaatgaaatttatattcctagtttccgtggagctgtgtgcatgaaaaacctaggttctcagtagctgggaggagacctgcacaggcatttttagtatatgtggtaggcagcttctaagtgaccccggtgatcctcacttcctggtcttcacggcctcaggtaatcctcttcccttgaggaactggcttctagccaatagagtacctcaacattgagggaggtgtcttctgtgatcgttttacaaaagattttgccttccaccttgttagattctctctcttgctggctttgataaagcaagttgtcattgttgaggagggccatgtagcaaggagctgggggtggcctcctaccaagacctcaccagaaactaggagtctcagtataatagcctcaaaggaaatgaatctgccagttatcatgccatggactttgagatgagaccccagacctggatgatcctttgaagccttttgaagcaccttgaagcagagaagatagctaaggcatgccctgtttcctgacccagttaacccatggttgaataagtacctctttattttaagcttcttagtttgtggcaagataactaacacatacatgaaagtctaggcttgggtatcatcaaaggacctgctagcagaattcttgtacatgaaaacacagttgtgcaggacatatctgtgcacctctttgctgaaagcaacatcctcaggaagaccacttcccagcttgcgacctaaacatttaggtctaaacacttgagctctaaacatttagttactcgctctcccctgtattaatgtatgctgcataaaggacccccattttcctacattaaaccctgtataagaacctccaagtagacacttatgcaaacatgccaagatgcaggaccacatccaaatgataagttgctgtcagtgaatcattaatgagcactgctgtgcaccctgccacatgttaaaaggtaaaattacattctgatgtttatttgagctattgcctattgccacttgaggcatatttcatggaatgataggagtagagcaaggtatttattttgcattattgacccaaggtgccatcagagtcatgaggtccccattaaaattccagtgaactcttagattctgccattcctagaaaatcttataacattcttggttcaaacttctcatctgtgatttaatgggatacactaaggtacagtgaaggcctggattaaaatgatgtcatttatttgctgcgtacatggtcctgggcaagtaattgaaacaaactctgaacttcaatgtccacatctggattaaaataaaaataaaacatatacttaaacactatgatcataaaaaattcagtgcctggcacttagtaggtactcaataattctgtctccccagttaatttattcacttgcatatagagctatttatgcagaaaagtttatgtgacaactaccagatatggatacttttatagaagagtatccataggaaatggctcagccttctgtcctgcaataaaaagtaatgtttgactccaagtacatgagattgaacagagttatttgagctacttttgataaaatgtgacaggcagactttggtatttcaccaccccaacatttttttatggactgctcactatcactgcaacattcagcacttttttctgtgtcaatgtgatagacaatattcatattcttcttgggtaattgcctttttagctgaatcaatggcttgcaggcatgagaaggaggctgttttatctcaactttatttatcttatgattatactaagactataaaactgaatctcccctccttcccttcctcccaggcccattcccaatcatcttctaaaacctctgttaatactcagcttttttggtgaattttcccactgccatgcttcatgttaccaaaatatttcccttttctgacaacattccaaatataaataaggacctactgaatgaatgaaccaccagtatgattcacccaatcactcattcaaaaaatattctttgaggatttactgtgggcagaccctggagatataagagggagggaggaggatgactatgcctacttgtaaagtggacagctgtggtctcttctagaaaggaggagtgcctataaaggaggcgccttgggtattcttactgagcataacagatggaactgaggagtcaaggagggaagccttctctgattatatgaccatggagctaagatttgaaggaaaacacataatggtgcatgtgtgtggggagggtggagacaggaggcagtggaggagctaagtatcccaaggtggaggaggcagcgtgggcaaagtcctgtcggctggaggaagggcatgttcttggtaccagaagcagctcagtggaaaggatcctgaagcggaggctggtgggccgagtccagaccctgggggccttgtcaacctagctgctttgtgcctggggcaatgaggaggctgtgaagcatcaacagggagatacagtatttagagtatctcaaagtctccctctgtgtggtgtttggatctttctgaatcctcagatgtaatataaattatttgaaagcaaataccaatttgcttctaattctggatctcttactcaggacttggttgcccagaggaggtttaataaattctttttaactctacttcccaccaatttttctcccttcgatctgttcctatatctctaccattcatggcagggttagcacgtggctccaatggtgagcaggaaggacttcacctcttgtctgtcccttagctttggtgtgtgctgctcctaacgtagctttggagttggagttaagaaccatctcatggcattgttgggttaggtattctctgggtccactcaagcttcctatcagttttttagggacagaaagctactgtgctgacctcagtcaaagcccctatctgaattcttgaaagagacatgattgttaggtcactaattgattctccatagtgttagaacagcaggagatttgaacacaagggcatggtgctataccatgcagcctggtagagttgagctgaataacttttaggtttgtaagacagcacatttaatttttaacagattatgtacaagatattgagtgacattaaacacagagttaaatcaaccataacccatttaaagcagccttgcagataaatgtctcaaatctactagcctgccaaatgtattccttatctacacacatttatcaatttttccacaacactaagcctttctaatgtttctctgacagttactttctctcccaagcctgaaattcgggtgacatctactttctgtaaactagatgtgcttgaccagggaaagcccctagatttgtgttaatcttttggggccactgacccttctgggactctgatgaaatctttagtttgctgtctaagtaaaaaaagaggtgatataaacatacacagatttctttttgcataattctattgtgttgcttttgaaattgattttattcacgttatatattattcaaatacatctttactaaaaagtgtcactcactctatatattttatatataaatgaaagattactttctaacaaaaattagaaaaaacacagtcaatgtaagttaatcagaaagtaaaccttaattgtattcaaaagtaaaactcaatgggaacaccgttgttttgtaagagtaagaaattttggtagtcacaaggtctttgacatggcaacatgaatgacagctttgcagttaagttctgcacctttggttttgatggcagcaaatatgtaaaaaaaagtcattgattcaggtgatagaaacaaaatcagaatgcccatagctcatgttgcaacgaaggctgtaacaggaaagcaggccctacatgactcttatcatttcatttatgtcccatgatttcttcaactcagttaggtcaactgtggtggtttcagtgggatgctatctatgtatgttaattatctattgttgcattagaaattttccccaaatttagtggcttacaagcaagtattattacagaaacattgcaatgaggtacttgtagttcagagtctttcacgatactgttgtcaagatgttggttgaaataggagtcatctgcaggcttgactggggctggaagatctgctttcaaagtggcaccctcacatggctggtggtaataggcctcagttccttaccacaataggctctgcataggactcttaaggtatttacacaaaatggcaagtggctttctcctgtgtgaaatatcccagagagaaaaccaaggaaggaaccagaacaccagttatgtcccaattttggatgtcatatattgttacttttaccatgctatatctattagaaatgcatactgagtccaggtccacactcagagggaagggaattaaactctatgtcctgaagggagaaagatcaaataatttgtggatatatttcaaaaccaccacactatgtcatcaaagaaggcgttgtatattcatgattcagttttaaggtggtttgggtaaagttaatagcacagttgatccatattcccaggtactggtgatttccatctgaagagaacaagatgaggctttgtcactctcaccccagactatcctccaacatcctttaatcacctttaagggggccaaggcatttcttttttcttttttttttttttttttttttttgagacagagtctcactctgtcactggggctggagtgcagtggcgtgatctcgactcactgcaacctctgcctccgggttcaagcaattcttctgcctcagcctcctgagtagctgggattacaggtgcccgccactatgcccagctaattttttgtgtttttagtagagacgggatttcaccatgtagaccaggctggtctcaaactcctgacctcatgatccacctgcctcggcctcctaaagtgctgggattacaggcgtgagccaccgcacctggctgggccgaggcattgtgtgtgtgtgtgtgtgtgtgtgtgtgtgtgtgtgtgtgtgtgtgtgtaagttttttcatgaattcaaaacatagccaaatggttttgaatatatagaatttatatttgcactgctgataatagcttgtaataaagctgtggaactatactgtttattgttgccccaacatgacagtgctggtgaggaggaaacaaagactggaggatgtaatctaccccatagatgagctccttgaggatatggctgcatgttaatgttccagcgcagtgattggcacataggggctataaagaagtatctgttgaatggatgaatgaatgaatgaatgaatgagtggagactcatggaatttaacttggacaggcaggttctaactgttgctgtaggcctaggaataccatgttcaaagtatggaagattggagcattggtaagaatgagctcttgaattctaaggcagtgctatctctagtctctttagtgttttctgccaggttggaagagtctttgcatgtcaagcatatgtttgccttcaaaaacaaaggtgaaagctggttgggattgcttgcttttagtgaagaccaaggcaaagaactctatctcctgggtactctctgtagatggtgggaaaaaggaagagaatgtatcaggtagcttttgctctgtgacagacaactacaaaaccttggtagtatattaacaagcagtgctcactgcccatgcatatgggctcagccatcagttaggtggctctgctgatcttagctgagcttgttcacgtatttgaggtgggctttgctccgtgactttcccatattgtagcagtgtagcttgggcatgtttttagagcattggaggaggcatgagagacaagctcaattctacaggtgattttcaagcctgttcagcaagcaatctactggccaaacatcccatggctgagcccattgtcaaagagggagggcactgaatagctccatggcacaggggggcgtgaagaatcggaacattttttacaatctattacaggaagccaaagaaatagctagtttttctctgtttaagaagggttcacacacattgcctttaaaaggacagatagtaaatattttagactttggggccacgtacaggccctgttctatattctttttttacttcttttccttttcttattatcctttttcttttaataatcctttaaaaatgtaaaaaaacagagatattcttagcttccaggctgtataaaaatagactgcatgccacatttggcccgtgagccgtagtttgttcatccctagtttaagaagaaaaaacatcttcatactaataataatatacaatattctgttggcaaaagacattttgatacttgtcatttaattgatcttcatagaagcctgattgttgaaggtggatatttctaatagctcccctttcatatggggagagatgggaacttatgtgatgaaactgggattcaggctgtagtagggccagggagggtcactgatgattacctgaggttgccctgccaaggacagctgcttgtgtcctctgcctctgagaactaagcttccaggaggaccaccggtagtagggagtgcattcagctccatcctcctgagaacatacactctgcaagtggagagaagccatctcattatgttaatttcaacccagcccagactgagaggaggctgatttcaagggcaaagaaggtgaggcagccgattcccaggtcccatttcccttgctccacttcattaacatggccacccttaatgcgtgtcataactctgccttccagcaagatttcctctccactaagaaccttttagaaatggtatttaagagaatgtgcataaaacaagtcttcatggtgattatgacatttctgctgaaccaaaatgtaatcagtacacacattttgcatccttacacttaatccacaaacatagcttttactgttttaccttctcccacccacaatccaaacagtgccacagaacaaacgtaacaggatattaagataatctcttttgtctatgccaaatgtcatttagctgttgagagaggaatgtcccatctagtttttacaaacaataaataatacagcttatgaaggtccacatgggtgacactgatgcaatgtttcaacagttttccgaaaaaggaaaataaaatgagtcatccaattagttggctgggcatttgcctgcaagttgccagagagctttgttgatttatcccaacttggctaagattggcttactctagaagttcgcctgttacagaagtttggtctttactagggtgacacaaagtatattttatggatattagttcatcaggatgctgagaagggttatagcatcaaagacaaatatggctgaacatattggggatcatttaggttaaagaaatttaaatgaatttttcctgcgggacttctcagaggctttaatctgtgaatgtgcatactgaatttccaagaagggtttagaatgtgcagcagtttccaaatctacttgacctgggaacccttttgttcacagggcatcccatgagagaacactttaaagaacagacgatgagaatcagtaccatgcgtaaaacgtgaccaacgttctatgcagaggagatttttgaaagtatccccaccagtgaagagttaccgtgtatgtgtataatgtacataagtggacattagcttgtattttcaaataataaagtcaaactttattattaaggaagatacaagaattagggctagtaagtgtgtgtgtgtgtgtgtgtgtgtgtctgtgtgtctttctatgtgtaaatgtccatccccagggattaagaagtctggatttgggttaaacttaatcatttctaagaatctcaggttttcagtcctgtcctagaatttcaaaaacagtcagagaaagcaactgtgagaagatcacagcttctcatcctgttttgagtctcaccctcctctttgccctcacaaaggatttcagtgattatgttcctgacaggatgcattttaattgttttctggtatgacttcccaatacatcaagttgtgttttctatatagccgctatcccaaatgattactattcagaacactaatctgatctctaaatctacaaagaaaaggccatgtaatttgcttctctttacagtgcattacgtgcaccattgtaagtgctggaacccgcccccccccccccccccccgccccgggcatctccaaactgctgtcctgtggatagccccagttgcatgtgctcaaaagcaaacttcttatctcctccatgagtcagttcctcttcctgtttttttctctcattgcagctaatgacattaccatcccctcaatgtccaaagttagaaacttctgagtaattttttatttctttctcttcctcaccttctactaatattagctgttaaatcctgttgatgctacctctgaaatatttctcaaatccacatctcctttcaaccttgggcatggccctagttcaaggtcctatttttcttagatggaccacggggtccttttgccatgatctctttttccatccaacttataatttttctacaactttgacttccatcctgattactaagacttttaacatttctgtgtgctccttcttctctgggtgtttgacatgcattgtcattctgtcttctgattgcaagtgatagaaacctactccagactagctttcagggaaaagaaaggaggtgtttagtagattgcacaactggcaaacctggagttgatttagctttcatgaaggctagaccttagacttgtcatcaggaatatgtcctatttgctttttctgtcagcagtccttcctttttttttggctgtgctctgtgatcacatgtctcattgtggtgataacgtggcttccagcagcaatcccagactcacagcccatcctcagcatttccagtggagagaagtgttctctcttcctaacactttccatacaaatcttagaaataaattttattggctcttaacatgtcacgtgcccatccttcaaccatttgctatgaacaaggggacaggatgctctgattagccaggacttagtcacctcccctcttctgaagacacagaagttgggacttcatctctacccagccacgtggacttagaatacaggatgggtgggtgcagtttccccgaggaaattggagggctgttcttggagcaaggacatgaataagcggcttacaaagagcaaataatcgttgcttatggcactcaaggtgttctgtcaccccatccaactcacctttcccacttggccttctgtccttgaatgcgaagaaccagagtcccctgctctaaatggctccttttctgtgtgtgctgcgtgtttgctctgctgctgagatccatgcttttcccttgcctgaaacaccctctgtggctgttgcagatgtgttcactctgtaaacgcagctcaaatgccttccaccccaaaaagcctccttaaacttgcccctgctcctctgtgtgaataattttcacagcacatgatctacacttccatcatggttcttgaaatacatgaaatacctaatcataggataggtttcatatgatcccacctcccctgctagacactgacagtgtgacagcagggcccctgtcttgttcgtctcagtgctccccagggcccacatgcagtaccttgtacacagtgcaggcaccataaatacctgttgattgattctggacttgccattcattaagagaagttaatggaggttttctgattcccatcagatgaacaattttggaatgttttatcagtcaaatttctaagaatcaataaaacttccatttggattattctttcccccactcaaattgtattttaaaaatagttttattgtaattgtccccctcaattctgacaatgtgtaagcattgcagaaaatttgtgaatataaaagtatgaagatgatcaaaagcttcttcctgactgatggccattgcatgtatgatttcctctgcctggaaccctgtggcccccagggttcagctccctggtgcctcatcaggcacagcttagtgtgagcttcacctttgtctctagatcttcctgtgcatttagatttttaaaaaatctggtgtatcccctcattggttggctatgaagtaagctccctgtgtgcagggacctttttttagcttggtgagggtgtatcctctccactgctggagctgtggtcagcacacagccagtgagtgctctacaaacacttacagcatcagttcatgaatgcttgcaaacatgcagaggttaccattgcttatacttttttttgttttgttccacttatataaaccacttatatattcagatatttgtgtatatatgcatatatatgtatttatgcacacataaacatactacacacactggatgtatactacacacacacacacacacacacacaatgttataaggtgtatgtaacacactcagggctgccccacagcctctcagtgccctacttatgttccgtccccccaccattccttctggcagcttctcactgtgaaccctgagatgttctgcctgagtgcttgttctagctgctggagcatggcaggccagaagttctggagaactcgtacccccaggatcagctctcaaccagggatgaatacagatggaggataaatttccccactcccttgcccctttggagatgtatttgacaccatttctcagagtctccagggagaatgagctccagtagcccacagtggtacctggactgataatgctttactggctttcttttcatatcactgcctcctggaaccacctcctaaataagctacttacattcgagaactaattccaataatacgctacttaagacaagggagaatggtagaaacaggtttctatacttcacaaaaatgagcttttgctcttcagaaatcacagccaatagattgtgccttctggctgccccctctgctaatgccccctctttgccccctgaacaagggcacccatgtacaacaatgtgtatatacttccttaggaagctggtcattcagagccccgtcagtgacacctgcactcagaatgtaatcctacccagcttcgggggctccaggaattcctgtggcatccgtgttatagactcctttgcattcagctttgcttttatctgtttccaatttgtgttttcaaggcttcggtttttctcctttctgcttcatctccagcccctcctttgcaacagtaccaaataaaaaaacccatgacactgccacagctgaaaaagcctttgaaaaaggcaggtggcgtggcttgaatgtttctaaactctaaaactgcaagccacagacaaataaagaaagaggtgggggtgggcatggggggttgtagtcttgtggaagcaatcctcagccttcagcaggctctaggggcacactgcctctagcatgttttgagcacgttgatttgggcatctgtcttgctgaatttgagtttgaattatggatgttacagaatgaatcattaaggctgtgtccacccggattgctctggctctctggcctgttcacagtgctgttcaattttatgtaagcattacttcaacatttttggtggatgttcttcatttattcattcattcagtatgcactgatggtgactctaagtcttgggactgcaaagatgtctgaggcccattctttactcctccacatctcaagacctaagggagatagacaggcaaatcaataaccacagtgccttgctattggtgctgtccaaggtgggtgctgtgaagaagtgcttaagggcaagtgctgcagaggcaggcacacctggggtccttttcctggcctggggggtccaggaaggtttcccagaggaagaagcagggctcagtcatcaagagctaaggatatgccgtcaaatagccctggcttattagaatctgctttgcactaagcctcctgaatacttaatttccccaagcctcagtttcctggtctgctaagtggccagaataatatttacatcgtggatttgtatgaaataaataggataatgcatgaaccatgcttagcgtgagccataacacgcaaaagcaacataatcagtatttgttaattgtaacaaatcaagcccgggatattgacagacacctaaggcagacttgggagacaatgtctcttgctgctgcctcatgaggaaggtgaatgaccatgcattgccactggacgggaaaataaacggtttcttctttttattcttgtagacaccagtgaggcctaccatatacctatgtcaaaacctgcaatttatcaaaaataaagcccgagatagtaacagtcttgctgaccacaaaggcaaaaggatccaggtaaacagattgcttccaggactattatttcatgatgagctttcaggtatatagcacatgagagggaggacaaggtgcggctgcacttcaagagaccacgttggacaggtgagatgtccaatatattcttacttaagatctgatttcttctccttctctccagcaagggatgcccagagatataacaattagaattcaatacgctaatacagtgtctcattagccaagccacacaatcgcctctagtggtccatatgcacgacaacccgggatcctagaaattagctcggcttcctgcatccgtccccatctgaatctttactcaactactttttgattgtgaagagccaagctcatttgagcagtaggaatttcatggggctggtgatcccaagactaattcaaaaattaataagtttcccattccttttcttatttatttttttggtagggacacatttcaccacacacgcctgcttctttcttgccagtatttcattcaaaactagtcctcaagttttgaaattttagagacttaaaaaaaatcaataatgctttaagaagattaagaggctgtgcttatgtcagccttagacaattctggagagaagatagacttgattgtgcttctcattttgtttatgatcctgcaatgtatcacgcattctctgccaagtgaattctgactgcatgaagaaggggtagatgcttttacaacaggtttagtcatctggcatattatttaatacaatcagtggtgttttccttcgtgagatgcagccttatatacaggctaggtgttaagtttatacccaggttatctacccttccccctcctgtcctctctcccaccctgtttttattctgtcttccctcccttcttcccttcttccttattctctctcttcctccctttcttcttcatcttcctgtcttcctcactcctcccttctctcctccccatcttctttccctttctttccgcctcccttctccctttttcgctccctctttcccttcacaaacatttattcaaaccctattatataccaggcacgatgcaaggcactggaaatacactgaacagggcagatgtggttcccgttacatgatgagtaacacaggtgataaataaacagttaacaagataagaaaaatggccagcgagtatttggaagaaatagacaagtgatagggaatggctttggggagaattatctgcatataaggataagggatgagacagactcagcagccgtttcatgccagggcagagtagaaggccgtggagctgctaggtggttggcctggagaaaaaacaaggagttttttctgcaaagtgctggtaggagtttacagttctctgtaatgttcagaaatgcagaggtcagcggaggtgggtggatcacctgagggtcaggagttggagaccagcctggccaacatggtgaaaccccgtctctactaaaactaaaaaaaaaaaaaacattagccaggtgtggtggtgggtgcctgtaatcccagctacttggaaggctaagaaaggagaattggttgaacccaggagacggaggttgcggtgagctgagatcatgccgctgtactccagcctgggtgacagagcgagactctgtctcaaaaaaaaaataaaataaaaaagaagtatagaggtcatttttaatgtgagaatgttctcagtgaattaggtatatgtgcctgccacattttccaaaccaatgtttttacgaatattctagtttagccctctcttctagagttataaaattattctgccttcagttctacatttagggagtcctcttttaaggaaaggaaaaggatagttaaatcaggggctgtcacagaagcctcagattggaggacaaggcgtggaccatcccctgtttggcgggaaaatagctttagtcacaggcaggttgttttgcttcctaaagcgtaaagttggaaatgtgataatttcgtcaagtagttgatttagttgtatcaagcttaactaattaacaccaattccatgcttgattcttttctccattaactgaacaaaagccattgctaatgaggctatgtatacaaagccagctgactcattttgttatggagatttcaaagagaagggagttgtaaacatttgtagggaagagataggggtagacatgatcttacacatatttaacaacaggtgcaatacaggcactggccaatgagaatgagcaggggtataatggtgccaccagcacatacagaaggagtaagaagtatcctcaaggcacggagagatgatagggtgcagggcctttgcactgggcttattcacaggcaaaatatttttccttattttaaagaaatggaaagaagtcttcctagaagccagggtctgtgatacatgacagagtgaccatagcactcaggggtgcagagggtgtgtggattctgatgacagattgcctgtctgattttgcagaattagctccaacatggttttggtaacacccgttgccctctttaagcttgatgtctctgttttcatgtaatttgcacaaagtaggcactcactaaatatttgtaggtgaagacgtgtatctcagcacaaagcagcctcttggactaccatctgtgtggtattcaaggttcttttggtttcagagaagaggaacacagtaaaatttacccaaagaaaggagcatatgtgtcggttagggaaagaccaagcttccataacaaagagactcccaaatccaatggcttgataagatgagcctttatgtcatgttttggtcccttggtgagaggcaccgactggcaggctggctttgccctgtgtaatcattccatctttttccttccagctgttgctcagacgtcaccttgggcatggtccttgtctgcatggttgaaggtggctcatgtgtatgtctgcttttcagtgcacgcatggaggcaaacatctgtcttttacattagagatgactccaatgttgcttacatcacactgttcgcatcccatttgctcaaatgtggtcatatgccacatacagctgtgagtgacgctgcgaaatctagctggctggctttgtggcatggcttgcattcttctgctgtgggagagaaggaggagagaatgggttttagtggacccacagggagttactataaaagtgcaaatagggcataaggggatgcaagaaacactgaacaaccaggcatcagagtgcaggagcctatggagttcagatgagagctctccttcgtgcttctctagctctcactctccatctctcacactttctctttttctgtgtgaagactccactgtctctgtctctccaccagcttcctctgatgtcctatcttggatctggccccagatagtatcctctactttcttgaccttgggttttccaaagccaactggtatcttcttacttgtctcttgattctaatttatctaaagggaagatctgattcgcccagctcaagatagtcagggtctaaaacaccatgaccactctaaaaagaggggactccgagtcagctgtctgcgcttatccaatcagatgacgctgggcaaatggagaagctgtcagttttctgagacacccctccccagactgacccaaacacaacttgcacagtgtgaatatcagagtactatgtgagaaagtactctgtggagctgaccagcatcagaaattctgctagggctctcttataaattgataacttgtttctcagtcttttatacatttggcaaccgtgaatctattctttagaaccagaagagtcctgagtgatgagttcatagattagagattctcatacttcacagttgagaagtggggacaggcccaagggtaagaatcagagtgagctgccagttacatcgctggtcagctcctctttcactgcagtagatacaatgaacataacaatggatataagctccaattctatccagttttccacgaatgaagatgagtctttgaatacgcccttagcagttctcaaaaaccaatcagcagaacaagtctggccagctcccactttacatggacattatcatcaaaagctattttaatcccaggaaccaagaaaaagaaaaaaattctgaacttgcaatttttttctgttttctgtttcatgccacaggaataatttttaagaaattctttaaaatagacccaattctatgtcttatttaaagcaacagatatgaagcagtctgtgtagcagacaaatttaatggttccaatcaggggcttggaattagactgcctaattttaaattctagctccatgcttgcaagggatgtaactctaggctggttactcagtctctctgatgtttctgttacttcatctgaaagtgtggataacactaataggtaccttgcgaggctgtggacaataaatgagataattcatgtcaagtatttggcccagcgactgcgacatagcaagtgttggctgaagataattattaggacttcacatgagcgttgttggaggagcttagcttgtttaacctggaatagaaaagatatggtaaagaggatgcaggagcttccatttagtatctacagggtgggccatcctgtttcctgtggcagagagagaagaggtagaaccaatagggaagaaatcataggcagacagatttcagatcaacaaagaaaggcaaaacagatagagctgtccaaagaaggaatgggtttgaaagaaataaagccccagaagggctctagatgaggatgtgaggttggataagctacataagggatgtcccaaagtcagaccatcttctgggcttgatagcatgggttaggatgggctgacaaagactgccttaaataaaagtatgcatacacacacacacactacacacacacatacacacaatacttatatgtaaatacatttaaatatattatatagatttaatatataatatatagttctatataaatatattttaaatttataaatttaatttataaattaaatttattatttatatattacattaatttatatttatattcataaatttatatataaatatatttatataaaatataaaatatattttatatgtttaattatatataataggtggaggcgggtggatcatgaggtcaggagatcgagaccatcgtggttaacatggtgaaaccccatctctactataaatacaaaaaattagctgcgcatggtggtgggtgctgtagtcccacctactcgggaggctgagacaggagaatggcgtgaacccaggagggcggagcttgcagtgagccgagatcgcgccactgcactccagcctgggtgacagagtgagactctgtctcaaaaaaaaaaaaaaaaaaaaatatatatatatatatatatatataaatatatttctatatttataaaatatataaagtatatatgatatacaaatatatttacatataatataatcattttatttgatttaaaaatatacagtatatttatatatttgtatatttataaatgtattttatatattgtatgtttataaaatattagaaaaatatatttgtatatttataaaatatataaaagtatatttatatacaaatataacctataagtatatatgtatgttttacatacacaaatacttttatacataaatgtgtacacatttcagaatcaaacagcccattataagcatatatgaaagaacagtttgatttggcatattttataaactgtcacctgattttttttttaccccaacattaaaaaaaaaagctagtgcataaacaaggtgcagaaagaagctagtcatccattcatctcttcttgtgccagtgttacaatatctagtagctgaaagtctgggccagtcatttgcccggaccgcattatgtctgaatacctcctggcagtttctacgtctttctcagggcttctaaataggaatgaacatgaaagggccgcgtggcagtgaccgcagtgtggaggttctaataatgactatgagggacacacagttttcaaggagatctaacagtgtttatgaaagattctgtttcatctcaccagtgaagagcccttcatcatctaccattctcttaaggatagagtcttagaatctccagtgatcctgcaggaccctcatcccgtggttttaaacctgtgttctccagaggtctagcattgagcggtggcacttgggattctggaatggggaggatgcaagaggaacacagtgaagtaaacagcttggactctggcccttcaagcatacttcatccactttcatctgttttaggcatgtgggttcaagaggtgatgccacttgaaaaaagattagagggttctgaaaaaatcaggtgtagaattaattccaacatagacctaccttcttattgcacagacaaagacactgagatccagagacattgaggggctctcttgggctcccccaccttgtccaggggaaagtcaggactgggatccagcgtatagtcacttgctacggctattcccattatgttttgctgctgctgaaacactggaacacattctaaagttcagacactcaggaaataccccacggtgataaggacaaccggtgatgccgatgagttcccaccaggtgtcagtgcctcgaggacttgtttaatcttcacaacggtgctctgagttaggtgctcatattagttccatttaacagttggagaaaatgaggctcagggaaattaaatcacttgctccacatcacacagctactaggcagtcaatgctggttttgaggctaggtgatctcagtccagaggcctcagccttaaccattctgctctctcgccttcctgcattttatactccatacttctcttgggagaaagatactatcatattatttcgtccaaacttaccatatcttaaaaaaaacttaccagcaaacaaatcatccaactgcctttcatctattgaatgttctacagacttaacgccattatctcgcatgaccttgatgaagatagtaaccctccctttatcaaaatggtcaatcttcattaatttattttactaattagttaaaggctggtgtaatttagagaaagtctaaattatagaatacattttattctgtcactttgaagcacaaacctccacaaagatttgtataaaaatgctcccttctgggactcacttcagtgatttgtagctaccattcatactgcctctatgtaaatgaaagggaggcataatatcagcaccttgcgtattcttctccatggtaataaatcgtgcctgataacctatgaaaatggcttcatttttctcttaccacgcctatcatggtggctttcaaactcactaccctgtgccccacctatcacacctgtcctttgtccctttctcacatggatgtctacaaaatgcagcagtaaagtgttccataatccacacttcagtctacataaatgtttaattcccctgccccttttgttttcgtcaggccccctgaagccgcagctgagatggctgactccctgaactcttcttatgttcttgactgttcgcatagcctttcctgggattacctcccagttccaagtttgcccattctgcaggcagtcttcttgggttccagcttttctccaccatcagcttctcccctagggctcttattaactctccgctctctgggggccactctcattttcagcttcatgtggatcagtgattacttgtcctatctcctctcctagaacgtgagcttcatcaaggaatttctctctattgaccctcaggcatgagcacaatgtcctactccctgggtgcttagttaatgcttatggagtgaatagaaccccggcgtgtgtgtgtgtggtgtgtgtgtgtgtgtgtgtttagggaaggcaaaggacgtttggcaaaaaaacaagttacctgagggaatagcaactcgaagtcattgtccctcaatttgggatcccggtaccacccgcataagaatcttttggatgctgaataaacctgcagtttctccagcctggccaagacctatcaaagcagggttcctgggtatgaggtccaaggatctgcaactggaacatgctctccaggcaattctatacacactggtatctaagaaccactgcgctcagaactaggatatccatcaagcctgatttgaagtacctgcatgagtcccagtgtcatgatgagatcaagagagcttctgtgtccttgaggggctggagtatgcgtccccctgaaaccctttccctgcctgcccccagcactgttgggtgtcccttctctgtgcttcctctgccaacactctgtgcggtgtttccgggagtcagaatggcagggtggtcaagagtacggactcagaggttgcagaaagataaaaagatgattgcattcatgattgttatgatgtcttgtacatagaatattgtcttatttgctctaagactccattaaaaagccagcaaaagcaaatgcataccagaaaaacagtggtgtgctctttgaatattaggtggcctagtgcatgtttcacctaggtctctgactaattctatgagcttgggcaaattatttagcttctttagggcttctgtatttgtgaaaaaaaaaacaaacaaaaaaaaaggaaaacaatagtttccctttaacagggctattgtaggaatccagtgagatcatatcttggaagtgctcagctgagggcctgggcgggataagtactcaaatcatacccttaatatcattattcttttttgagatcaagtttcactcttgtcgcctaggctggagtgcatgttggccaggctggtctcacactcctgacctcaggtgattcacctgtctcggccttccaaagtgctggaattacaggtgtgagccactgtacctgaacaagtgggtgttgttttaagccactacatttgtggtcatttctcccagcagccacaggacactcatacgtccataaaggcagcttctctgctctttgatgcctctgactccacttaagccctcttccccagggctgaaccaacatacccgcttccaagtctattaagtattgaattgtgttcccccaaaagatatgttgaagtccaaatccccaggatctgtaaatgtaacactatttggcaacagggtctttgcagataatcaaataaaaatgaggtcattttggggaagaagctaatctactgttactgatgtccctgtaagaagaaaagagggtcgggcatggtggctcaggcctgtaatctcagcactttgagaggccgaggctggcagatcacctgaggttaggagttcaagacaagcctggccaccatagggaagccctgtctctactaaaaatatataaattagctgggtgtgttggcatacacctgtagtttcagctactcaggagcctgaggcaggagaatggcttaaactgggcaggtgctggttgcagtgagccgagatcaatccactgcactccagcctaggcgacagagcaagactccatctaaaaaaaaaaaaaaaaaaaaaaaaaaagacacaacgacacacagagaacttgtgtgatgatggaggcaaaaactggggtgacgcagctacaattcaagggacaccaaaactgccagcaatgaccagaagctaagagaacagcatgaaacagactgccatctagagccttcagaaaggacatgacttttctgacactttgatttcagactttttgcctccagaactgtgagcgatcacatttctcttgttttacaccagccagtgtgtgatactttgttccagcatccgtaggaaactaatacaaagtcccaaactctttccactatgtctagatccaaagtcaccaagaggcctggcttggggcagcactgggaacttagacaggaccctagctaagttccattctgagttaataattgttattaactcactcagttcatgcccagttagcaagcatcatgaagcacattaagccaggatatggcctttctaaatgtcctgagtatcaggagaagctttttcacactgcaaaagccagtctaattctatgacttgcaggctgaaaatcaactatggctgcaaccaagtcacttagccatcatcagcgccaatcctgcagtgcttatagccaagtcagggcgtctgtttgttgagaggcaaaggcggccccgccccatgctctggtttctgcttgcaccttattaacgggtaatgaagagtaggttctgctttattgatcttgagaccagagctacgtgcgatgctgcctaagaaaagccgcaaaggattttatttgatttttgcacacaacaataatctccctcaccagattagctggtgaactggtgggcttttcaccttgaaattgttgatagggtagccaaacaggaatttctatatttgctaatccttcctcaaatacacatccccaccgtctgtgccctgtcaagtgggtacctgggaaatagcagagaccacactgtggaaggggagacactccagtgcaggaaagatcagaagaaagaggtgacaatgacatgcagcacgaagcagcgatgatggggttttttctttgcaaaattacaagccacagtctcacctcattcctacctgccttttttatttcccctgctctcaaaacatacctgactagaaaatccccagtccaactccaggaatgccctttcttctttagccacatcacagtgttaccagatgccttttatgagctctttggtagaaactaagccatgtgtcactactgggtgttgaaaactcaggagtcagcttccctgcagtctgctggcgctcagttctttggctctgcctaaagtcggataaggaaatgaccttccaggcatggtgagatgagtccttaggacacagaagggcaggctggcctggcctcaggagactgcaacagctgccagagagccatggcactcctcaatcccccgaggagcctggaaaagacttccctcttgggttcaggcatgtcctctgcttcctgcctttatggaaactggattttcgggaccttggaggacctcctatggggaatagaaactaacagcccatcccgagcctgcttttccatgggaaaggtggtgggaattctccatgtcacctttgcagagagagagagacaaacatggatccaaattagagatggcttcaggttctgacggattcatctctcccaattgcctttgtaacacatctgctaaatttagataagtcacaaatagagccaaaagaaaatccagaagggagccacaaaaaattattaaacagttgtaaaagttggggattatgagtggaggaatcggggttatttatcctggaaaagagaaggctgaggagggacatataaagacttcatactagattaattatgtaaataagcagacacccagctggcatggaatttcaaccatttggcagggagagtgggtattaaggggggtgactagttgttttaaaatcattagttgcctgcacaggtttctggaggggttcactgttgctgagtaatacaagttatgaatatgccaggtctgttttaatgagcccagacttcacccaccaaaaatcctttccagccaagcacgtgataactatagatcttctttgtcctttgcctcaagcagaagccttacacgggtccgtcgtaagatgcacctctagggctcattccttcttcaagtcccggtgtagagtttggtgttagaagggacaattagagacttagagattccttcgtccagacaggaagatgctggaaggagtgccttttggggaatgagctgagcttggccagatgctgcagttgtgtccccttgctgaagttagtcacacttggctgctggagaagtctgcccaggtgcacttcataaccacactgccatcttctgcctttcattcaacaggacatgaattgagcacaggctggtcctcctgagccctggcccaacaaggctcctgaacctgggcccagagatgcataagaggatgccaaatcacataaaaaataagggtatggtgaaatcccatctctactaaaaatacaaaaaattaataaggtgtggtggttcgcagctgtaatcctagctactccagaggctgaggcaggagaatcgcttgaaaccaggaggcggaggttgcagtggattgagatcacaccactgcactccagcctgggcgacagagtgagactttgcctaaaaaaaaaaaaaaaaaaaagagcccccccactcatccacacttactctcttacaatcctggaaggcaacttgtttcaatgggctagaggcaagttgttggctagaggagattccattgctggactcttttagatcctggtggttcccgacattccttagcttatagccacatcagtctagtccctggctccgtggtcccatgaccttttgtgtccaatattcctctgcccccctcttatgaaggaatttgggattctatttagtggctacccagataatccaaaataatctcttcatttggaaatcattaatttggccacatctgcaatgtctttaccacaaaagttaatatagatgagttctagggattaggatttggtacctttggggatcattattcagcctactgtagtaggggttcatcagttagtgggggggaagtagccagtttattcccaaaatgcatgtgtcatcacaaaccaagatgagtttcctaaaagaaaataagatactactgcgaatgtcacccaatgagacctgacccattctgtgtgtgcagggatgctgttttagttgggttcccacagaagcagaccctgcaacgatgatttgtgtgcaaggtgtttatttgagaggtgatctcaggaaaccggtaaggcagtgggggaagtgagacagggaagaaagggcagccagtgatgggagttgctttcaagcagttgcttgttcttatgggcagctggagctgaatcccactggggactctgggagacaatgaaaaccacatctcatagttatccccactgaggaatgagggacctggggtatttatctaccaactccccttctattattggttgagtccctcttctgacgagtcacaggtattcccagtaagcagcctctgtagggcacaggtgagtgatgatgggattcaccgctgacagctctgctgtagatttccccgggcaggtgacctctgaactgccacctgaagtagaagtaggaagtaaccagcaactggggtggggatggtgaagaagaaggagaaagtgttaaggaaggaaacagaaagtgccaagccctgaggtaggtggggcacagtgtagtgttgtattagtccattttcacgctgctgataaagatatatctaagactgggcaatttacaaaagaggtttaacagactcacagtgctggggaggcctggcaatcatggtggaaggtgaaaggcacatctcacatggcagcagacaagagaagagaactcgtgcagggaaactcccctttataaacatcatcagatctcgtgagacgatcacaagaacagcatgggaaagacccagccccatgaatgaattatctcccaccaggtccctcccaaaacacgtgggaattatgggagctacaattcaagatgaaatttggatggggacacagctaaatcatatcaagtgtccagagtgaaaggagttgagatggaacagcatctcaccagacctgagagccatttggtgcgtgttggatgcatgtggtccgtatctgttctggttgattgatgcctgtgccttgacatttgttcaatattttgaatatccttcacactgaggtcaatatctctttccctgggtggttatgagccttaaatcagctatgccatgtgaaagttatttgcagtttgtgaagtcctgtggaaaggttgttgctgtttttctgctggggctgttttaagatgaaacatggtatgggggaaagatgcaagctctgggtcccattctcaggagtttccacgagcaggaacctcacatcactgccattggcctgtaatataattttggcctgagtctatctgggacaggtggtgtggagatgcactgttactaaagacttaaagcttggaacttaaaagtctacattttctttggagtcaggtggtcctgtgtgcaagtcccagttccaggcccttccactggctgtccaatggcttggagtctgaggctcagttttcccacttgcagaaggaaggaatgatgccaacttcgtaagttacatgagatgtgaaggcagtgatggaagtggagctggggctccttccccctctgttttaagcatttgattaaaacaagttaggatgggcgcagtggcttgtgtctgtaatcccagcactttgacaagccaaggtgggtggatcacctgaggtcaggagtttgagaccagcctggccaaggtggtgaaaccccgtctctactgaaaatacaaaatttatctgggtgtggtggtgggtgtctataatcccggctactcgggaggctgaaacaggagaatcacttaaacctgggaggcagaggttgcagtgagccaagatcacgccactgcactccagcctgggcaacagagagagactctgtctcaaaaaaaaaaaaaaaaaaaaaaggtcttactgtaccatatgtcctcacttaacttcattgctaggttcttgaaaactgtgactttcagggaaatgaaatataatgaaagcaattttactgtatgctaaatggtataaacaagagttaaattcttacggcacgttcctggtcacaaaaacattaccaaacttcttaataaagacccaaaacacttctaatattaaacattgaaataaagatgagctatacatacatttaagaaagatgaataaaaacaagtaagataatcgtttgctcaatttttggtgaatcagtgagtgacggtggtcgtagtggtggtgggttaaatcaaggaataaaggtttgcaaagcgaaaattgtcaggggcacctcctgccaccgtgcagtttgaaaacaaacaattccaactaatggcagactgactgagtgctttcttactgcattgttttttattgtgcatttttatgattattatacacagtacttcatgagtttttgttttacaatacttcgtattaattaattcaccttccaaattgcttagtctataatagtttagggtcttgggtggccaaagcctctgctagcacagggtaggaactgaccctggacaggacatcattccatcgcagggcacacttacacccacgctcacactcactcatactggggcaatttagatgtgacagttcacttcacatgcacaactttgggatgtgggaggaaaccagaggacccggggaaaacccacacaaacatggggagaatgtacaaactccacacacagggtggtctgggccaagagttagtgtttttttttttctcatcaacattataataaaacaacattgaagaaaacagcattatatgatgtctggatgtatttattgttcatgatggccaggtcttcctgcattgttgtttgagtcagtcacagtgagttggcattgctacaagtcactgagcaaaaggccctcgcctggctcattcgccaatgagtctcctgtgcctgaaacaaagcttggtaaatagtagatgctcagtaaatactaactgaataaatgagtgagtgaggtttactggagaagggatcaagaacctgaattgatttagctctccccacatgattatgggatgaagccatgataattactggcacaaaacattcattttatacataatggaagtataaccagggatgcaaagtgatttgctccaagggtgctcagttaatttattcaatgaccagtcattcctctccttgatttaacaaacattcattgagcacctacagtgttgctgatgatattaaaacctcagtttctatcaaaaagcataagacattgcccccacccttgataagccatgacttggtagtgggttcacatacataaacaaaggatcatattgcaatgtaccatgatctagtatttacacacatgatgtgctgaaggaatacagatgaaggaacatcaattctgccttggggcccaaagaaaccagttgggaaagttatatttaggatgagtgagggacacggaggttcagaggtcctcaggcagttaaagagggagtagggtagaaggtgcaggataggtatgggcacatggaaggtcatggaactggccagtcacccagtgaggctagagtggaacactgctcacgtaggcaggaagaaaggtactccaggtagaagtaacagcaaagtcaaagaaagcagtcggcaaagagatttgtaagtttgaagaattaaaagatgaaccataggaatgaaggagagtgtggcaagaaatgtactttgacagagagaacttgtgccaggtcattctggtctttgtaggccatgatagagagttcagattttgttctaaatacaatcaaagccattaggaattgtaggcactgtacttccagtgagctaagttttggggtcagtctggtcactgtgatggagcagagagggcagggaggagagtcatcaggaggctgtaggtgcagaccaggggaaatgccagttagactacactatgctgtggcagtgggaatggaaggacctgatgtgctttcctgaaatgtagttggggcgtgtcacatgcttgagttctgtgtccctaccctctctcactgacccatagtcggacagaccacactgccactgggcccatcgggaggcagggatgggattcaaggaagacttgttggtttggatggaaacacaacagagtatagaataaactttttttcaaatgttgtttcaatttaattcagtaagcattggagatgtattttcatcagaaccctctcaattttaaggggttaatgtctaactcaaatgggaaatgtatagttcacttaactgaaaaggtccagggagttgagttttaggcaaaactgaatacaggggcttgaatcttgttaaatggtttctctccatctcttggctctacttttttctatggtgacttcactctcaggcagggtcttcccatgtgataccggctattggcagactcagatctgtagccttataatttcacaaccccagcagagagagagagggctgctattactgaacagtccttgcagagggctggcaatgatttgcccagtttgggtcccatgaacacggtacaggtactgtgccagatgaactgctggaattggctacgctagggtcacatggccagctctgcagctggggatggagtcacccttattttcatggaccaagtatggagagtgaggtgatttcccaaagacccactaggacactggtatgtggagaacatgagagatggcaggtagacagaaggacaggtacctactacgagcacctgccattgtatgcaagctctgcctagttctcctgcaggaagttcaggagtgaataattcagttcctatccccaagatgctcacagggtaccagggatgcagatacatacatataagcctttttcacgtgagcccacctgtgaagagtgccctgatttgatggcatgtccagcaccaggaagctctgactgcttttactcaaatggcacctggggccaaggcacatgttttctcacatttctattttaagagtcaataaatcatttctggtaccttaactggatattaaatcagggtgtttttcttgtcccctaatacagggccaagatgtctaaagttgaccttcagtctagtccaacatctggaaatgagtactaaagccaccagcacagacaaaaatggagaacaggtggacctggggaacagtctggggaaggaggggttccacatgagaagttacctgcagggagcagttgggtggcttgagttccagcctgagaatgattgtaatgtatctccttaaatccgtgtatgtaggtggcactctgttcctccttatccttgtatttcatctgctctcagggctgtgtttctttgcttcttgtgggcttttgcttttcagttcagcacatatttattgaacctttttgtggggactggctagttattcaccagctctcttccttctttgtcttgggaacatagctaggttatattccccagcctcccttaagttctctgtgactggattctggtctgtgggatgtgggatgatgtaaagtccaccttacttcagcaaaacctcctgtgaagttctccatgcaaatttgccctattcctctgtctgccacctggaagaagaggatctggtgggggacagtggagccacaagatggaaagaggagtctaggttcctaaatgacagcaaggagttgtcaatcatccaaactcctgtgcaaatacaaaactccacaccagattgcgacaggagtgaaagataaatctttacaatgttcacttgttgaaattttggagttattttctttttgtttttgctttagaatatagaatttagcctaccttgagtaatcagagttaaaaaaaatataagaaattgtgccatgtgctaggttctcagtgttgagcaaagcaggtgctgctctggccttgatggagttttcagtcttacctgttattttttctattcccactccgtcttccactccttgcaggcaataacagatgatgttgggggcaatagtcttgaaataactctggtaagtgcccagcagagccagatgctgggctgagttttgaaaatgaacaacttcattggtactctctgagcctttcttggagtggggcttgtctgtgggtcacagcctgatcctttaggccttgtgaagcttgaaagatcctacaattgtgcagggtaaagaggttttttgttatatacacaaattgtactttttcttatttctcatttttgttctcagacaagtccttctaattagttagaatttcattaatccagtcatccttccatccatctatccatctatgcatccttccgtccatccatctatccatccatccatccatatatttattctttagaggtagttttattaataatagttgtcttttgtcaaatgctcatttgccaggtgccatgctattgatatgactagtcctttttaattcaaatgacagtcctacaaggcaggtgccatgattatcacttaataaatgataaactgaggccttgagacatttcttcagagtatgatcccatatatgttttggtagagcctagattcatagtcatgatgctgtccttcattctacatttattgggatgccctcaaatgccatgtctgatggaggcatccccacctagagtagctgacttgaaggagttcacactgtatgtgtgtgcacatgtgtgaagatggatagtcaaaagagactgtcatgtaaacaagtaatgcaattggaaaggtgctgtgcaaagtagctgagagaatcacagggccctgtgagagactggaaggcacccagatgatccaaggtgatggccaaacctacaaacaggggagccagggacaagagcagggatgattgaatctagagtcagactgatcgtacaccctcagtcttccagttggatgtccttggctgggtcagccattctctctgtgactcagcttccccacctataaaatcaggataatttagctcatacttaaagggtagttttaaagattaaataagatggcttcttaaggattaactgagataatacattttaaatagggcttggcaatactaagttcttgataaatattagcttattttgtgataatgatggtcatggtgatggtgatgatggtgttgatggttgtgcggatggtgatggtgatgttgatggtcatggtgatggtgatgatgacagttgtgctaatggcgatgatgatgatttggaactagaatcaaaagaatgttttcctgctgtttccctcattgcaaataacgtacatatgtctctttccccatactcgttattgtctctcaagttctgaattgtcccagctctatcaccaaaccaggtttgtggccttgggcagagcataaaagatgtcttggcttattgttctctctatagtgagggagaatagtgggttctggagctggactgtctggcttacaagctagctccaccacttagcagcaggatacccttgaggaagtcatgcaactcctcagagccccagctttctcatctgaaaaatggggatgaaaatagtaactgccacatttaggtgttttaaggaatggtaaaatgatctgcataaaactataagcctcattcctggcacatggtgacctcttaatgaatgctagatatcctcattttgaaattaagaggtgccttcaactttacttggtggcttttctctatacattgtacctttatttttactttggaaagttgtatgcagtgccccgaatgctgacttgtaaactgatttgaacaccatcctcattccttttggctctctgagaaatgttcttttttaatgaatatgatagcaagacttacttattaccaggttatttcaggcaagagtgatttttaactcattaaccagataattattgcagttctccagttacctttctgttcatagacttaataaggcctgaggttatgtggcagagttttcttggctaagatgggagaattattaaagctctcaggtgaaggtgtgaaacctttggtgcacagagggtggccgtgccattcaagcagtccgtgatggtgagagggagctcagctgcttagggaactggtacagggtttcattaatcatgggacatttctggtgtacttgaaaatgttagttttacttatgggaaagatatccagacgtaaatgtgtgtgtgctgtgtgcatgtgcgcacggtaggttatacagcaccaaggggtcaaatagactggttgactgtatcctgtagtggtttggagcaggtgttggcaaacttttcctgtaaagtaaatattttagccttggcaagctataagatcttcatcacagctactcaattcagccaatatagtataaaagcagcaagaagatacatataagtgaggatgtgactgtgttccaacaaaactttattgtggacattgcagctggaatttcatataattttcatggaccacaaactgttactttcttttgacatttttctactgtttacaagataaaaaccattcttttctcatgagctgttcaaaaacaggtggtaggtgggatcttgctggtgggctgttgtttgctgacctctggattacagtctgcatctgttgcagcttatttcaagcaccgcttgtttcattatttactttatcgccttgggcacactccataagtagtcagtgcctcagtctcctcttctgcaaaagagaaatcagagacttcctatgttggtagagaaaatttgtaagagttagcagagattaagtgccttaaacagtatctggtgcgtagcacccccttgagaaatactagcttttattgttttcattgaattactgtctcatggaattcttacaactacatcatgaggaaaatagtattaatagtattatccccatttcccagatgaaaacactgaggcacagagctgtattctgtctgaggccagagttagaccatgacttacttatttacacaaagcagcagggacctgtctttgatgatgaacaagtccaaattactacaaaactgcttttgttcttcttctaatgaagtgcccaggattcccatccatcagaaattgcctgtgcctattagaaactgtcatttggcaaggggatgagggcggcggcggtggtggggttacaagatgcgcaggtggtatagggaaggagtggcaaatcaaatgacagcaacagagcagccgttactgcattttatttttttggcattttcttccattgttctcctttgtggacacactctggtgtttgcactgggggcatccctgttgtatttgtaaatccctggaggttgcagttgtaaaatgtgcctttatcctctcccattgcattttttttcctctctaatgcaccaaattagaagattgactgattttcgttttccctggaaggtaaaatttcagcttaaatcacaaatgtctgtgatgcacttagcagccaccgcagcttctaaccagtaaccattcctccttattccctctctacccaggagaatattcaggtctattgtgatttcgagatgcattagccgcacttagagttaaggatcaactttggcttctgtggaagctgctgagatttaaagggtaagagctcatcccatttagaacatggtgtattctttccctccttgctcatatcatttatgaaaggataaaagactggagaaagtgtcagagtagattctggaggtacttatattgctaggacaaaaaaaagaaatcacattaccagtagctggcttagttctgcatgttactatgtgatcagtttccaaagttcttcgtcttggaagacaggcagccccaacctatgggaatctgctcaccctacaatggtgagcagacccactccacccatctttgccattcaagtctacagcatttgaacagatcagcccgttctgtgtcaagaaactccttatgcatgttctggacacagccctgtgtctctgcaggttcaaattcccctgaatgagagaaaagttagaatcttcccttcgtatctcagcttctctactcattactcaaacccttgggaaagctgctctattacttattatgtctgcttcctctggaaaatggcagggtaatatgaataccttatttatagggctgctgtgagaatcaatatttgtaaaacacctggaagagagcttgacacatacaaagcactccaaaaatgttctctggcattaaaaacatttgataatatgggctgggagggatcacactgcttctcagatgcaatccttcaatggcaccccatttcttgtaaaaataaatactaatctcctcaacctggcttacaaggccttgttcagtttacccttatgggcttgttctatccatccacttttcctccccagcgacacggtacaggcacacctcagagatattgcaggtttggttctagaccacagcaataaagtgaatattacaataaagagaggcatacaattttttttttgtttcccagtgcatataaataataaactacagttacgctgtagtctattaagtttgaaatagtattatgtctaaaacgtgtgcataccttaatttaaaaatactttattgctacaaaatatgaatgatcatttgagccttcagggagtcataatctttttgctgattgagggtcttgccttgatgtgacattgatggtttctggctgatcagggtgggggttgctgaaggctaaggtgaattggcagtttctaaaaagaagaccacaatgaagttgtctgcatcaactgactgtttcttttacaaaaactttctgtaaaaattttgtatagcatgtgatgctgtttgatagcattttacccacagtagaacttctttcaaaattggagtctaccctctcaagccctgctactgctttgtcaactggtttaggtactgttttaaatcttttgttgtcatttcaacaatgttcacagtatcttcccaaggaatagaatccatctcaagaaaccactttcttggctcatctataagaagcaactcctcatctgttcaagttttatcatgagatttcagcaattcagtcacatcttcaggctctatttctaattatagttgtctttcagtttccaccacatctgccgttacttcctctactgaagtcataaagccctgaaagtcatctatgaaggctagaatcaacttcttccaaactccttttaatgttgacactttgacctccttccatgaatcatgaatatttttaatggcttctagaatggtgaatccttttcagaaggttttcagttcactttgccccgatccatcagaggaattactatctctagcagcaacagccttacaaaatgttatttctttaataataagacttgaaagttgaagtcacttctagatccatgggctgcgcaatagatgttacattaacaggcatgaaaaaactagtctcgtacatctctattagagctcttgggtgaccagctgcattgtcaataggcagtgatattttggaaggaatttttttttttttctgagcagtaggtctcaacaatgggattaaaatattcagtaaagcatgctgtaaacagatgtgctgttagacaggctttttaaaagtagcactgcaagagtaatttaggatgattatttagggccctaggattttcagaatggtcaatgagcattggcttcaactaaaagtcactggctgtttagcccctaacaagagagtcagcctgtcctttgaagctttgaagccaggcagtgacttctctctatctaggcaattcctagatggcatcttcttccagtataaagatgttttatctacacgaaaaatctgtttagtgtagccacctttgtcgatgatcttagctagatcttctggaaaacttgttgcaactctctacatcagctcttgctgcttcatcttacactcttatgttatgaagaaagctttctttaaacctcatgaaccaaactctgctagctttcaacctttcttctgtagttccttacctctctcagccttcagaaaattgaagagtgttagggctgtggattaggtgttggcttaagggaatgctgtggctggattgatcttctattcagaccacttagactttctccccatcagcaataggactgtcttacttttatatcatttgagttttcactggaatggcactttttatttcattcaagagctttcttttgcattcacaacttggttgattggcctaagaggcctagcttttggccggtcttggctttcaacatactttcctcactaagaagcttaatcattctagcttttgatttaaagtgagaggtatgcaactcttccttttccttgagcatttagagaccattgtagggttattcattggccaaatttcattattatgtgtctcaggtaatagaaaggcctgaggaaagggagagagagggagaggaaaggctggttggtggagcagtaaggccatacacatacaacatttacctattacgttagccttcttgtatgggcatggtttgtggcatcccaaaacagttacaatagtaacatcaaagatcactgatcacagatcaccatgacagatatcataataatttgaaagtttgaaatattgcaggaaagaccaaaatgtgacacagacaagaagtgagcacattctgttggaaaaatgacaccaatacacttgctcaatgcagggttgccagaaaccttcaatttgtaaaatatgcagtatctgcaaaatgaaataaagtgaagcacaatcaaacaaggtacacctgatgtctttcagttggcttaaggtaataattgctgcagccagctcagtccagcccagatttgttacattttcatgaatttttcaaatgttttgttaaatacagctatcattaaaaattaaattgcatcaacttataattaagttatattaaaagaagggtaatatgggcacaaaactgaccatttcctgattattttactacattttactattttctatgcttatttagtcctattatttatgtatggtgaaatctatataatggggaacagctgctcatagctgccagcacttcattcagtgaagtcacattggcagcttgaagctggccatgccgggagtatttatatgacaggaactggcaaacacctcagggctagatgtcttgtttttgaactagaatggcagtcagcaaacttttttctgtaaaaagctagaggagtatcctaggctttgtgggcaccgaaccctctgttgcaattactcaaccctgcagctgaagagtggaaaacagtcatagaatatacatatataaataaatgagtatggctgtgtttcaataaaactttatttaccaaaacaacaggctcacagtttgctgaactctagtctagacttacaaaagtgatagagaaaacataaagaatgcaaattaaattttaaaaatgtgttgattctggtagctgttacattgtatattgccccccagaacacaggacatattctttaaacatctgaaaagtattttgggattcagcaaagaagctgctcaagacattgacaaataagtgaaattctgacttaggtcattggtttattttcaatcttgcttgttcatttaaatggaaatggcaatcaacattgatatgggaaccacacttgctcatcagttctaactgtaagttggctacaagtgtaagagtttggaaaaaaatcaacaaaagcattctgtgagaatcaattggctgtgtgtacaatttacaatatagaaaattgtgtgttttattatttgtaaattatgtgttacttatctttgatatcagtgaaatacataatcaacatatatgtgcctggacatgcctatattggtttttgtgtagagccaattattaacattaccagaatatcactgcttgaatggggcatgttctctttagcttccaggcctttgagtggttcctccacctgaaacaatctcttcttccctttgcctacctaactcctccttctttgatctgcagcttaaatgtgacttcttcaaaaaagacttctttgatcccttcagtaccaaatgagttcttccctttatgcacatttttccttgtgacacttgacttaattatagttaaatgatgaattatgtgctggcttattacttcctttttaccaaaagactgcacgcttccccaggtagataggtccatcttctttatcatcgtgtctttggagtcttacgcagtttgttgaaatattatgtttgtagctgaactgaattgtgatttaaaaaaaaataggtctgtatttaaaagttttagtgtcagctccatccagcccaagttaagtactaattcagcaagttagttaagtaataaatggctgtcactcaactacaacatatttgaattcagttttgaggccccagtagttgctaaaaatcaatgcccactttctccaggtatagtaattatttctcatattgttattgactgtctctttaaagaccagccaggacaaatctatttctgaagctgttgtaaatgatttgaaacaggaagatgaatggaatggaatgagggttgtttaaaagagatttatccctcttattcttgctcaagaaatgagtggccagttgctaccagcctatcccaaaagccaagagataaaagccagcagcagttaattttctagtccgtgtgctagtgaccacagatatctaaccactgatttccaaaggcttactattattcatacatatttactatggtaaatagctcatgttttcaggaacactgaggatctgtttagtcactttggatttctggtttcatcaagagtttgtgtccgacatctggggatgagtgagggttccggatacccattacagaggaagagtctgatggggaaactagagggaattcctatctggaatttaaatttaagtttaggatctcagaaagacaaatggagttgaagctgtgtcaggcagaagagatatctccatttgtttttctgctttctcaacataaggcaaatgtcagtagtaaccaggtttattccacaggcatactctgcaatgtgtgggtaattgtgcctatcgattgtgacaaagtcttcaagcatgaggcagagaagtttgctatccaactggatgccctcaacaatgtttgcatctcaacaatgtgtcctcacattggctggctttacatatgcagacaagtgaggacatgcagaaaatcatttcactggtcctccccattgcattgtcgattgtgtggaggctaacatgtaaagttatcagcccagcagcagacacggagtgagttgtccataaatagtcattctaattgttctgtttttcttattataatttatttttgctatgtaaaaaaaaatcaaatgatctattgcgtgtatatgtgagtttttgtttaaaggcatatgacccaatttgtaaacatgatcattatcttctctgggaagaatactaaccaagggaaagagttcatgatttggctgtgtagagctctcattaagtgataggtgactggttctgtgctgagtgtttttcatcatcttgatcctatgagacattcaacattccatcttcatcttacaaatgagaaaactgaggcttagtgaggttctatagatgctcaaggtcacagacccaacaggtgactgagctggggtttaaatctccagggggtcttttagtaaggcttatgcttttaagcaccaaactctaccaggatataaatggcaaaaggaactgcttaagatatgaagagaaaagaaacacactacttaacacaaaacaaaaactggataaaatacccagttgcctgaatatgtatgcacttattcttgcattcagcaaataagtacatagcacctatcatgaaccagtgactttgcttaggaacacaaagcaagcaaaatccctgccttgatggcacttacttcttagggaaaagagaggatgacagaactgtagagaaaacagagtataccagatagcaatgagggctgtggagaaaataaggtgggaagagaactaatattggagctgggatttcagaaggaagaaagtgtttgagttgagacctgaaggaggtgcaggaaccacaggaccatctggggtcatggtcagcaacatggccaatgggccaactttggcccactacttgttttcatgaataaagttccattggatctcagccaggcccattagtttatgcactatctgtgtctgtttttgtgttcaaatggcagagttaagcagttgcaatcctgtggcccagaaaaacttaaatgtttactatttggccttttatagaaaaaaaaaatgtgtccacctacatctagaagaagagttttccagggagaggggacaggcagcacataggagtctcaggatgggaatatgcctagtgtgtttgaggaggcaggtgcgcctgcaacagaatgggcaaaggggtgagtggagggcagggcctgggcacgtgggggccactgtaggggagagagggaggattctgcagagtgttaacaggaggactctcgctctttgtgatacatccactgtcttaggttgaagaagcaactctgagatggagtttagcattcagggccaacacctatggaaagcaggggcaggaagcaggagtgagcagagggagaagtccagctatgatacagaccaatggcaaccttggccactctctaggagcttcagaattgaccctgtttggcccaagacagacaggcctttatactccagtgttgatcggtcattgaatataggtctttcaatggcaacaacagttacaaggaaggagcatcacctgggtgattgttgagaagctgagagccgagggctgcctgctgaccgcactcccagcagctggtgccatgggtcctgcattgaagtaggatcttgggggcacatcacaatgtccagcacatagaggatgtagggagtaacagctaaagcaagactaattaggaggctactccggaaatctaactgagagatgaaggtggcttgaaccaggaggtggccaagagttggcagactctctcttttgaaggtaaagctttcatatattctccatggcctaagatcaccttaaaggagcaaagtaaaaggaaacaagccaaggggaaaggcttcaaagattcagtctatgttattaaatctccccacccattgattatcatccatgacagtctttgcttagcttaggtttacctgtgctcatcattttccagggtgtacagaaggaacactatttaatcacaaacgttccaatcacaaatgcttcagtgacaggaatagaagctgtcacaccagacagggcagataagtccttgtcacatggctgggtctgtccctgcagtgactgtgctattcatagcaagaatgttgtgttgctaaacttggcatgaaacaatacagttatttatgcgacttcatgaactagagtatcgccttggatttgagattctgctaaagctacatgagtgggcaaatcaagaaattgtattccataatttgtttccaatctgacagagtactatgtgtaatagatgaataagcttatagattttagcacatttattgcagtgtgatgtggtttgacacagtgtctatgagctgtgtggggtgaaatggaaggtttaaatggattccagcttcattatcccactgtgatctgaggaaagcgagaccacaatgttgccatccagtaaagcactttatcacattccttcccaagttgaacagcagcgttctgccaaagaaaagctatttgctgggtagactctttagcaagtttcatttttaacttgggtgccaagccagccaatagaatctaatgggctttgcttacaatgtgcatggcttggctatttacatgagattgacagcacgagaaaaaccagacgctatactcactaggctgatttagaggtttctctgctcatttgaattcagccaagctagtcagtctagccctgggaaaacctgcaagagtaaaaagagaaccaataaaagcgattcatgaaaaacctgaagtgcataagaaattaattcccctgagtttccaaactagtcagtaagctgcgctgaggttttgctttctatgtttctcctttgcttagggactggtcaaaatctcgaagccacttgttgatttttctctctttaaactgctttgatggaagaacacccagggtgtaatgggcacctgggtgggtggatgcctaactaaatatatttatataatccttgaaacatgtttaactctggaggttaaggaaggcccaaagacaaagcggagttgttaagggaagaaaaaaacagaacttcttaaaggttgacacggtgccactcattaattctagaaaagtttgcaggggctgttacatgtcagacacaatgctagccttcccagatgcattgatgaacaagttgcaattcttgctgtggtgagctaatggtaaaaataaacagagcactgccacacacagacataagagccatggggcagcatcccattccaatgcctggtacatattaggaacccactaaatacttgttaaggttcattttgtgatggtatttttttcctctctccgctagcttaaatctgttcaagtctcccatggttaatacgataatttttctgatgtttatcaccaataaatttttagaaaaatcaggctacacagtcactctctccaccttcttaggatacactcactctcttaccctttcactccttcgggcaatttgatctgctatcttttcccaccactttaagagaaggactcttgatggggttcccacacctggtcagatggcctctcttggttgtcttcctcaatcctttcattgtgttgtagttgggcagttcctccacctttcacttctcagatgcagcataatcgtgtttcttcctcccctctgaatattccttttctgcctctctgcattccttttcctcttcccaacacctaagtgattcttaaaaatattctctgactttctatgccttctccatcagtgttagtttcaagttatcttgtcatagtttcatttaggagataatgcctgaatctttatcttaagccttgaaccctctagaacaatttcatttgtgtgctgggcacctggatgtcccaaaggcatgtgaactcatcatatcaggagtcaaactcattctgactaattttatttaatgctatttccattcacttggtcatccaggtggagacctgagggtcaagatggagccctctcccatgtctctctctttgctgctctcagatggacccaggggtcatgtgctgtcaactcatccatcactatatttttctcctttgcccttccatgttatttccatttcacccaccgttgtgtgataccacagcgtctgttttacctcccactgaacaaaagaaatataatccttgaaacgtgctccttagtgtggaagagaggggtggtctgatgacttgtttcaaaatgatctcaatatcaaccactgccccaacggtcttgcatttcatacttaagcaacatatttcaatgcagagaaggtttatagtgtggtggggatttgagggtagcttttcaattctgctctgtttgatttttgactgatgaccccagacacagagatttggcctggcagaacctgcccttagttctatagaggacaccttccccatacttttttctccttttcctcttcctctataaactctaggttctttcactgcatttcttttttgtaaacagctttactgaggtataattgacctacaaaaaattgctccggtttaatgtatacagtgtgatgagtttggatatatacaagcactggtgaaaccatcagcttcataatcaaggcttccaatatcattcacctccaaacgtttccttatgcccctccagtgtttgttgatttgtttgtggtaagaacacccaccatgcaatctaccctcttaataaaatgtttaagtgcacaatgcagtactgtcaattacaggcgctgtgttgtacagcagacctctagagcttactgatcttgctaaactagccacttgtcacacattcgttaggtttcatgacagtctgtcctctgagatgggctaagagttagtctgctctcaaagagtttcttgcaagaatatgatgggtgctttgtggtgaaaagtgaaatagcaataaaaaaaatcagtcacttccattgtaaaaataaacgtaactgcatggccaatatgttattctaaaacagaagttggcttcttacctggctttaccgtgcacggaggactttaatttgtgttcctgtcaaactctaggaatgtgaaaatgtggaaagcccatcccaaacaaaaataagcctcttgccggagtcctcacctgaaatctctctcattctcacccattcacctttcaaatctgtgcttttagcacatcacctttctgccctaaaacgtttagtggctcacaagctagtttccaaattccttagcttagtagttagccctccgctaccttttcttaatgcacttttacacttttctccatgctgtaactaaacagcactacctactaaaatagaaagatacctttcaggttcctgacctcatgccagtatctaccatttccttttcctagaattctctctttctccttatttaaatcctgtgcattctctagtgcatttgggggaaaatgtcatctctttctgtaggcattaactctctatgccctaaaatttcatataaccttggtggttccttttatctcacacatttcgcttatttctttgactaatgttattcatgaacatgtcttaccatttattctgctgcacctacaacccctggtggccagtggctgtcttactaacttttgtgttccctgtgcctcacacatcacagactttccagaaccttttagtggataaagttaatgcagaaatgagttaaatattcaaagaagcagtgagcaagatacgttttttattcttcctttcggaaatgaatccttgctcttccccacccctgggaactgtgccctggttatgattgagatctcatagtcactcatcattcattctttagttagaattgcataacattttattctttacaataaagataacttgttaattgcttaaccagatgtgattttactattatattttttagtaattacataaatcagaggaaaaatccttttcagatgatatgcccttatgtgtgatttagacaagctgaccacctacttttagataaagaaatcatcttctgccaagatggggctagatgtgagggaagagaagtttcctaccaagaatttccatttaaattcaaatttagaagctttcttagtccctgagtcttattccacttcagacttgttgaaattttcctcatgaaatatgctttagttgtcttggtaaattttaagagtgagagaagaccaagtaacagtttacaaaggtaagaatcatttaaacctacttactctccctgtttaagcaatgaggaggattctgtttatttatttttaaaaagtgttaagggaagaagtgctatttcaaattaaatgaagacacgggaatttgcctttaattatttaaaatagtttaaatcttgttgttcaaacaacaccttgtctctacaaaagaaaaaggaaaatacgatgacactcagactttgtcaactttttccaaatattagcaagttaaaaaaaactattggttctgaatggtgagataaatatatgccacctgtaatatttacctgaatagtatatattcagaatgcaatattgtgtaatctcttttaacttcaaaataacccttctttgccctgcaaagatacttgaactcttggtgttggctacctatgaaattatgtcaaacacatagattctacatctccagatattcaaaactaattatcccttaatttgcaagtgaaagcaaaataccacctaatagaccatttctctggtaaacctttctttatcttaatgagcagaatgtggacgcctattacaacctgattttaaaacctccgtgccactcaacagcttactcataagactgaccagaaggaggcaacaaagatgtaaatattcttatttacaatatggactgagctcatatctgtctatttagcattttattataatgcatgccatcccaacagaatcaatagttgattgatttcttatgtaagagacttgagtactttaattctggatggaaactcatcagcaacttccagttgatgagatgacgttctccatttggtgaaactgggctacatttaatcatcacaaacttcaaattgtattatcccactttccagataatgtacagcgtattagcccaacccgctttcttcagaagtgtctttaaacagagatgggctgtatctagataggggtggaatatgccagtgtatcggttagccgttcctataataatgctgcataacaagccatgctaaaattccatggcttacacattgctccataggctgaggggttggctgatctaggctgggctcagctgggcttgactccagactgtgggtttcattcaggtctgctccatggacgtctcattcttctgaggacagcgtgctccttcggaaacattcttttcctgatggagactgaaagtttccaggttagcatatagaaacacatgatgcttcttgaagtctaggtaggaactggtgctcagtcacttccacccactgggcaaagcaagtccaatatcaatgggggaacattctgtttggaagaacttcaaagcctcatagcaaaagcctccatatggggagtagtgaaaaattgggaaaaataatacattcgatcacagctgctttgttttagggtttatataaaagaaataactttaaaaggggttacctccttctcatgcctatatttttaaaagtaagtgtattactctacattgaataacccaagctaaaagtattttatagttaaccttgacctagtatacatactctctcactctcactctccccacacccccaaacccaacaatgaccacagatcttcctttccttccactttcacaacccaaaacttgtcctgttcattctctgctcaaaagcccatcagtgaatccctgttgccattgatatagctcaaaccctcggctagctttacaataaccttcacagtgtgtggtttgtctcttccatcattctgtgtgaatttacttgtctgtctttccacatgttatttcctttgctgggacactctcttttctctctcccacctgcctggtgaattgatgtttattcgtcagagcccagctcaaactttacaacgtctgcacatccttcactaatcccctgcaggcttttctgtttccttatctgtggtttacaagcattttatacatatggctataaagcacttataataatagactggaattagtcattcatgcgccttttgctgctagcctgtgaaatccttgaagatgggggtccatgcctcattcattttctatcgttagcattcatctccatgcctgtaacatggtaggcttcaaataaggtggttggattgaaaagaaggagattttaaaaataagcatttaagaaataaaaaggagaaacagccatggcacaaacagttatgttcaacctcgccattaattaaagacactataaacaaataaaaattatagatcaatttttatttttcaaatagggaattatgtttttagaaagacaagacatagtattgaaaaaaacatggatatctggcattgccaactggagtctaactgacaactttcagggatttttatcatttctctttctcaagtacttaaatatattcatatgtgttgacccagaaatttgattttaaataatttatcaagtggaaataaagatgtgaaaaaattacataggattgctgattatagcatcatttatagtaggaaaaaattgaaacactctaaatttcttacaatatcagcccggttatataaaatcatggtgtagatataacattgggccaaaacgtctgccattattagaggcacagttaataaaatgggaaaaggtttaccatgtatgttccaacataagaaattaagagcacaagaaatgagaatcttgtaaaatataagggctattgttagttacatcccatgtacgccaaaaactgaatttgaaagaaatacaggaaaatattaatagtgattacatttggatgtaataatcacaggatgatcttatttttatttttttctttttgcctttctctagtttccaaattttctacaatgaacatacatagcatttatagtaaatgaaaagatctaaaaatattttaaagatataattatgatacagtaacttgtactgttaactgggcttgtgtgagctctaagttattgattatgtatagctctttatgtgagtttctgctacttttgagccttgacttgtttatctttagattgggttccatttctcttttgtaattaactaagaactgaaatgaattttctaaatagaattgttcttaatttaaatatgaaattctgttttctctaatgtaattgtacctgagtgaaagtaactgcaatgaggactataaaggaagataaagtaggaatatgatgtataatttccctttgcataattgtaactctgaagaacgcatgctcccagcagaaaagtaatttaaattatatcacaacaaatgccatattttaaaatagaaactatccatcatgtactgagtaaagctggtggcaacctatacatctcaaaaatatactgaaaatccctccatgagtccattaaaaacaaattgattggtttaattccagcacatgctgaaggaaagtataagtgacattaatgtaattttaagtgcataaaattactaattacatatttagaaaaaaattatgtaagagaataaccatgagaaataatttttattataaaatattgaaatgtgtacaatgtgaacagaatagtataataaatcccatgtatgtagcgcccacaacaccttttatttctcagtacaatttttattttggaaatgatttttaaaaatgtagaacaatacttttgtctttatcttctgggcaaaaccagttttgaacaacagtgaacattttaataattgtagaccagtgctaatatgttttttgtttttgagacagggtctcgctctgctgcccaggctggagcgcggtggcactctctcagctcactgcagcctcagacttcccgggcttaggcgatcctcccacctcagccttttaggtagtggggcctacaggcgcagaccacggcacctggctaatttttgcatttttttgtagtgacagggtctcaccgtattgcccaggatagtctcaaacgatccactcacccacttcagcctcccaaaatggtgagattacaggcattagccactgcacccatctactaatacatattttgaaggcataatttgaaatctgttggaacaaatgctccagcaaagacattaaaatatatttttcacctagacagagaatagacatacctttcatgtacacaatttaaaatacagacccaacactcagcattcttttccttggtcagcataaagcgtgtgaatatggaaaacatgtcaagtgttgcttgtcccccactgttaatgttttctcacattcctgtccagagatagttctctgcatcttttacattaaaaatcttgccataagtgtatttttaatacaaatattttctattttataaatatgacatagaaaaatttcaagctattcaggtgtatgtaattaaatttgattttttacaggaaattttgaaattgttatagtgattaattgatttgttcatctggcatgtattaggcacctactatataccaggtgctcttttagactttggagaaaacagtgaacaagatggataagggatcccatttttaaagcacaaagttttctccagctatttcttaatggagagattaaagaaatcttcgcctccaagaagtctggatctaagtcatctccctttacttgatcaggcccatttccaccccctagttcagttgacagagataggatggcagcctctgccagcatgtttcaggatatacccaggaagcaaatacctggttggaataacaaagtccaaagcgaagcaagagggtgattgttaaatgagtaattagaataaacactgaaaaatggtatctgcctgggcctctatttttctcgcttttgtagtcgtttttcataggttggacttcttgcccttcagagataatgaaccacaatatgcatctatctgtgggtagcagtagcttgagtttgggattgttcctcgggttcctagggatttttttgaaaaccaggagaggattttctgaacccaattggtccagttaatgtatctatacgtcttacttctctcttttccaggcataaatctctgggctggcttctagaataccaggtccctttcccctcagttcctgtgtatcctgtgttatagctccaagaaggagctataacagggttagaacaaagatctcccctccctactactcctggataaaaatcacagctaagctgtgacttttgagtgcttagcacatgctaggcactgcagtgaatacttctatacacatgatcgcatttaagctccaccacctatttcgagggctggatgaatttatgtttcttgtgctacatatgaggaaactgaggcacaaatagcctcggccatttgtacaaggtgcagagcctgtaaaatggcagcttggcagtgatacccagttgtatcactctaatccccagagcctgtggccaccatacagggctgcctctcacaacacacataaatagccatatgtctcataggtagcattgacagagtcaattcttttccagtacggagagcggtgaattttgagaagtgactttttggcagaaatgcaatctagtgacaaatcagcaaaaggttagagttcagattaaaactcagaatctctgacttcagagtctacaagttaatctgtgacactttaaaggctctgggaaacaaaagaatactgttgaatctggttaccccctcagactcaggctgacttggagttgtgtgcgtggggcgatgccattccaatggtagccgctttgctttatggggttttaggaagaaatccaagcttcagtagcctttcccaaccgaatgcattattaaagatacaacgtgtaactcaggactgattttgacattttaaacatgatttttctccattaatagagtaccataaagtcagcagtaacaacattacagaaagctgagaaagaaaatacggtgaaaccccgtctctactaaaaatacaaaaaattagccgggcatggtggcgggcgcctgtaaccccagctactcaggaggctgaggcaggagaatcacttgaacacgggaggtggaggttgcagtgagccaagatcacgccactgaactccagcctgggtgacagagcgagactctgtctcaaaaaaaagtcttactgtaccatatgtatgtggttccatcatacatcatcgtaggtcatcgtcacctttttctcccttaggtataagccttttcttatgttattgtctcttttcataaataggatttttcatagtgacatacacatcattgaattaataaaccacaatttaagtaactatttccacattactgaatatttagcttgttcttttagtcccctccagtttgacactgcaaacaccaaatttggtcctctgttattttacttccagaaaataattttttagaactaagattaccaagtcactaatatttttgtggttcttaatggatatatattgccaactgcttttcaaaactattgttatatttaataccatcaaaatatatccattcacaagtttaattacactgtcttcatcattagtcataacgttttaaaaacataattgccagcataagagggaatctatctatgtctttctatttctctctctctatatatacatacattttatatacatataagcacacatcaaacatactatatactatatacatactatatattatatgcatggtgtgtgtgtgtttatatataaacacactgtttatatatatgtgtttatatataaacacactgtttatatatatgtgtttatatataaacacactgtatgtatgatgcatgtatatatacatattttaaacaatttctaagtcatactcaaatagagatgatagtactttgacatttctttaaaatctaggcaaacctgagatgcttttatcattgaaagtagaaggtgtccccattactggcagggaaatagattccagaatttcatattctctccaggtcagccactacaaatgagaactgaagaattaatctaagacttttttcatttttaaaaatcgggttattactttagcagaaatatgactttatgccttcataactaattgtactaatttatgaataaagtacatttttatttaaaaaaccaagaggcatactagaagaaattaatccacttattttcttctcaagtaagtggtttacttaagcatacatatatatacaatttcattttcctaagacctagaaaaaattcccaaactgatttcttaaaatttttacttgaaaaaaatttcagcttataaagaagttgcaagagtcgtaccatagttggaaatactctgaatcatttgctttgttttggtgtgatagagattttttgtaacgatcacttataatgtaactccctggaatattaaaacaattgttaaggacctgatgttgtgattagagcagccctgtttctttcgtttttatattcctgacagtgaaaattgctgtgcaaatagtagaaactcagaatgtgttgttgaattgaattgttagattgtcttagtcctcttctattcaggcattttctaagacaatgtgattgatacaaacaagtagaaaatatgctttctcaatacaatgagttttatttccagtgggactgtttaatcagaatgaaatgttgttgtaccatgatgactgccctgcccttagaagtcaattattttatgatggagaaaaaactgtggtccgtagatcagtagaatcagcatacctgggacctggttagaaattcataatctgtagccaaaacctatggaattggaatctacaattagaagaccctcaggagtatgcacgttaaagtttgaggtgtttaaagttaaagtatgcactttaaagtttgaggtgtgtttattcaggtagctttcctttcttctcatatagtttttaggtataaatgaaaggtctggattatttcacgtattggcagatgtgtatttattttttagtgcagtgcttctcaaagtatggtccctggaccagcagcatctgcattacctgagaacttatttgaaatgcaaattcttgggtccttcctcaggtccgaatcagaaactttggagaatggcactactgtttaacgagaccttcaagtaattctgatggctagagtttgaggaccactgctttaatgcttacgagagttgaattagttgtttaaacagaaatcttagaggctttgaatccacttacaaattagtcttttcaaaggtgtactttttaagtgtctgcataatgcgaatgttgtgaagtatgtcaactcttgggatttaggaatagcagagtattagtattccagaggcaaaattgtaattggccttttcacttgcattttccccacaagtgacaaaaggctaaaattaacaatagaaaggcatttgtttacatccaggcaaccttcttttttaaaaaccaaggcacaattttagatagttgataatacctggaaaagcttgggctcaacttgaggaagtagattccattttacttttcctttatttcccagatacagagaaatccatgttaaatgccttccgtgggtccagaacttcttgcttgttctctttgcccccagtctcctatttgacagagcagctgcactataataaatgactccctggcatttcagcatcatagctggggactctgccaaagccctggccacgtctctgtagtgggacgtacaacaacgaagaaaagaggctggatccacaaaccccacaggaaattagtctcattattgcaactcaattcatgttcccatccagaagagggcttcattgcacatggcaattaatttactatgcagagtgtgttttgcttggtatcagcttttattctgacttccaggacaaaatggttgcctgagttcttaatcgtgtgtgtgatttgacagtcaagatgggctatgggaatcatctcttggtagtgtcatcagcagaaagaaaattcttttctgaattgagctttggttgtatgggatagatatctgttctgttggtggtggtggttgtggtggttttgtgttttaatttttggattgtgacctcagtttgagtgagcaatgtgatgaagctgctaacaaaaaaatcaaagagaaaactctaaactctgttaataattgtacattgtaaggtagtaaggcatgttagcctcactgtgcttgtcacagatcagaatctacctagagagctggggtacacgtagaagcccaagagtactagatgatctcctataaagagccaggatggtagaagacctgtggattggccttctgctatgtttctgtttcccagcatcttttccctcctgccactgcctattttaagcaattttacttgaactttcaaatatgtgccttggtcatcccaacagatacctgcacctagttggccaatcagatcactaattgtccggtctcagcgattgatctagacacatttatgaccaatatatggcaaatgagagttctttgggggaaattaatttgaatgttgcagagtgttggccttctcactcccctgaaatatgagttccaaagacaaggtgaatctggaattgtggggtccaatttttttttcaaatggacacagtgagttggataaaaagcccgacagagccaagaaatgcagagagaaagagagagagagagacagagagagagaaggaggaaggtgggaagagagtgacagaccttacggtgttattcaaatccctggatccagctgtacctaaagcccataccttgagcttccccattacatgcaccaatatattatctgtttaatgagtttgtttgcattacattcaatgaggcttcacttacatagcccaggagtctcacttacgagtaatagtttgaagagagaggtaaccctgatggagaaaaaatgaagatttatcgtgacaggagtggggcaggaaaacccacttcccttcacatatctccaggttcggaactcatctattcctcctaacagtgctctgaagtattacctagcctgtgctacagatacaaaaactcaatgtaaggctctaacttgtttaaagtcacatacagagtgagagagctgggactggaacccatgttcatgcgattgttttaaataggtgtccctacttctgagtttccattgcattatgtatatattttccttgaacctccttaaacttaacgtattataaatgtttgtagagtctactaggctatgccttgacagtcattttttgcttccctcctttccttccttcctcacttgtttctttgcctccctcattttctcccttcttcctcctttcctttatgttcaccagcacctaacatacatttatgcctattggaggtgtcagtgatgttatttttgccaatgactgaatgaaagaaaaaaatgtataagttgaaggctcctgtctctagaaacatggaactaaaggcaagtcgatttttgtttaggcattatggggagggtattcctgggtggggccaaagatcagattaagaatcccccataaccctttaaagtcaacagtccatggaggagttgcaccaaaaagagactctccttctaaacatctgtgtgtgattcctggaggacataagttgagcggggtgcttttggaggttaactccaaaagcagcgatgcttcagagggcagcggttgtaaacagaaatcaggaagcagatggtgggggtatctgtggccagaaataagaatatctttattgctgagtaaataaacaagccacatcctgactaaatgggtggaaatttcctgaacatccaggaaggatgtctggtctttaatctgtttttggaaagtcaacctcagagcactaagcccaagtgtgtgcctctaccagcctcaatctttatcttgtgatttatcacccactctctccttctttagggagcttgttggttattctgcttatggactcacagaagagaacaattcttcctccctttgcccattcaattccaatctgaatgttagtaccagactaatgatctgacatagactgaagaaggttccaaggacttttctgaaagctgagcccatttttgttcaccattctcttaaagtctcaggtggagaaggaagaccttaaataatagcttttcttttataatgaaaggggaaaaatatctgaaagaatgcttccagctgatagaggttggacagaacagtaaggagaaattctctaagtccacctggagcttattaagattgaaaattgcaagagattggcttaagctgattttttttttcccaacagcctaggcaaagactctgatttccaattttctgttatggttgagtgcattcttccggcaaatatttagtaggcactcttaatgctaggactggtcacttaaaacaagtgtctttaaatattcttaatttagacacataatcttcaaaccacaacagtgatggaatgaaagctagtcatcagcagtttgcaaaaattatggcgctggtcctctccccagccaacttaactgggcttctaccatcctcctccttcctgatctttcttttctcttcctgagcatctatccagttccctatttaatcatatgtaatcttcagtatgtgcttttatgtggaaagccagatgtgtaccagttgatgtcaccatgatggacaagaaaaagggaagcttacagagaagggcagattcatgggcttgcaacatgtacaattgcatagggccctgtgcttaacaggagggcccatgcgtgcgagttaatgctctgtcatcactaccctgaaattcttaatagatttttttttgtgttttgtaaatgaagcccaaaggaacaatggagcatgagctggggcttggagcctcacttcacagacagccccacctcctcctgcctcctcacttccctgggagaggtctttagccacctgatccctgaccttgccctacacaaggcacacactgacctcctactacagcacctcattgcaactagcatggaccagagctctggggcagggaggtttttgtcaggtgcatgtaacccacatgcagaattataggacagagccccaggttcctggaaaggtcagacttatccttcatatattccatgcctgagagagcacaatattaaatagcaaataaaaaacaccatgacagattgagagaaagaccatggaaaacaggtaaaaaaaaaaaaaaaaagttttgtctgctttttagacaagagatcgcacgttttcgttttgtacctagctctgcaaattatgttgcaggctctggttacatacagcctttagtttatcagcacacagtgttggtgagcggatgagaaatgtggatcctcccgcaggtgagtataaggatgtctgaatgtacagaaagcagcctgatgtaggccagccccatacttaactgacgaatttatcggttgtatctgtcttccagaaacatacaggctaaacgccaacaaacaatgaccatgtctaagcatctgaatattcctctaagaaatcaactgacaaatttgggggaaacaagatgatagctgaaattaacagaatatcccccaaagcagcagcatgggaaacaagtgttatttataccataagctaacaaggcaggcctgggacaatcaatacatgagcctcctttccaccaaattctcttctcattatgtaaataggatggcctgaggtgcaagaacaatgaatagaataataatcggaaatgtaatggaactaatagtggatttctccggactgttaacttctgttcaaagagcccgccaatgatggatagagagcggcgtgcagaaaggaatctttccctggttcagcttgggtgcactgccttgtgctgactctgtcccctcccctacccaccacaccccatgtgtctagaacaatctcctctgcagtacttcatttcctaaatgaattagtccagagccctgttttgaacagatgcctgtacagttcttgattggttgaggcaagtctaaactgacataagccctaactctgaaacatgtgactttttactttgaaaatgtccaattctcagttgtgagctattcatgtgcaagtaacaaacacctactcaaacaagcttaagaaaagcagggaattcctgggaggatgcaggagcaggaaattgagccagtcgttccaaagggccagaaccagaaggcagaccactgggtcccagacagatgggtcatctctttccactgtgattcaagccctgatttgtggcctttgcctattttcatgatatcaatacctccaccgtggctgattgcaagctaccaatgacgtatcatagaatgtggcactggggagggatgtgcagccgcaccccattattgtaccccattatgtagtacttctgccatgcagatataatagataaataatcttaaaagcatagataacagtcaaatacatttgtaaaagagttaagaagtgatgcattttgagtattcattgcctttgcttttaagattattgaatcatgagtgcatgtaatgtctaataacatcaatgtttaactggcttagaaaaatcctgaaatttcaaaagtgacctcttacaaacagtacgtgtcagctcctacttattattcctcctcatgagtccatggaaacagcctctctgggaagaaggcagagagcaggagacaggtcgtggtacagaaggaagtgactggcagaagtacatggatggcatctcagttcaatctctctttattattttggcataattcaaagttcatatctcacttcatctcaaaaacaatatgcatatctgtccttggcttcattttcctcctacctcttcagacatctcttctctggctcttccccttaacccctaactgggggctttctaccctgtctttgcacaccatttatcctctctataatgacaactcctaaatctaagaaatgggcacatttcccctgctaagctacagacctgtgtatttacgtacttcctagatattgccccatgcatggcccaccatcaccttaaattcaagatatccaaaacaattctccatcaaaaaaaaattctttatagccaaatggaagtgtgctgtaatgagaggcatggactttgattctagtgccaaattgtaggtcttaatgagcttgctgactgtgagcacgtcactgattctccctcatctcagagttttgccatctcataaacaggcttgacctcgattaatgggttttactccacaatccatggggccctttattctgtgggtccacctcagaagctgtccaaacatcaagagagaagtggccttggtccagtcctgggcaccccatctcccatcaccaagggccatctgtctttcatcttttcatatgttaaagttccatgaactatttcttctctgaagtagtcatccactaattcattgattcactgtgaatcatgaataagatcatgatcactcaggaaccctctaggtctagcattccgtgattcttcggttagtgctcacgcttctggaatgaaaagtacaaaggtacaggggcagcagctggagatgacagcacagtctgttgccatgtgtagttcatggcgcagggtcagggcagaaactccttaatattaaacttagtgtacagtaactctaatgcctgatatttgatttgcattaagcactgacaagaacctttcatgtctatttctgccctggggtcctaaaacataaattttaacattccttgcttctccttgatgatcattcccacatagaaatggaactgcattaataatgattgttgaaaaaatgaataaatgattgttgaatgaataaccgaatgaatgccaccagggaaaattattgtctccatttcattttagggcctgaactttaggagaataaagttatcctaaagagagctgttggaacctgcctttctaaccagcttcctattttctagaaaaggggtcactgtttgtaggaattgtctaggattcctgagaactgccatcaaacattcattttgcttttcctattgctaagcattatcagacagagacacagcttctacacaaaggaagatggtagggcattgtctgttcagggctgctagatcaatattatagttttatttatctattaatttatttggatttctaagcagctctaccttttgttacgatgattatatggcaaaatgcaaaacaacttgacaggactttgctatctagacttttgataatgatctctaaaagccaactcatttcatttgcgtccttttatgaataatacaaaaaaatccaaaccttaactagtgtttgtcacagtcagtgggtacttcatgagccaagagtgcatagaaaggtatttttggttcattactaggtttctataattgacctgacattttgtgagagcaatcatgtttgttaaggagaaactcaagccaatgctgtagttgcaaagttctccttactattaccctgggaaacaaattcatcagaagtgtgcagatgtgttttatgtgtgcgtacacacatacatccctatgcatacacaagcatgtacacacattggcatgggtcgacctgataaaatatatgcagtgttctctttgtccaaatccagctggtcatctagggactgtatagaaaatttgccagtgcctgcagccctactccatgtttccctttttctctgcagcttgagcctcaccttaaggcctaagtgagatatgcattctgtcccaaatgatggctcatggggacagaacatttctgagtcttcctttctgaccctctagttatatggcagtgattgcactgagggaaaaccaggaaataacaaaggaaactgcttaagcaagttgtgtttgggaagattagaaaagggagtgcacaggaggatgaagctgaagtctctgaggaggtaatcttgttcaaataatagcttttcttgtaaccatattttgtcaaattggttatttctgatgatgtatccccaattttctgaaatgttttaaaacttacattgtagctttctctcatttccttattcctatgttctcattctggtccatcatctgttcatttattcagtccattctttgtgtattcattcaattattctttcaagtgacatttactgataattaaaactgttaaaatcactgacgtcaaggtctatgagcaaaactgaaccaaaccaaaacaagaactaaactagaatccgttgtggcgggattgaccactaggtggtatgtccattctttggccttactggggatttaggcatttgttttggttatgtgccttgttaaatattcatcatgtcaaaatggtggtagtaacatgaacacaatcaagaaaatatgaagagagtgatataaattatatttggagctcagagaggggccaggaagactttacatgttggattgcttctgccttaggcagaaaagaagttgcagagcgttctaggaggagtgaaatacttgagtaggggctgggaagcaataaagcaagtggtattttcaagtttatgcatccacaagatcagtgttcaatatttaaaatgttcaatgtgtaaactctatcatggaaagatttttgaggaagtagcttgtaaaaagttgcatatttctatttgttgctagggttacctaaccaacaggttcttggctaagcaaaaaactacagtctgtaaattagatattctggaataaaaaatttggggaaagaggaaaaggactcatgctcccaagaaggccaagtgaaaagtgatatccttctgatagggaaagaagtcatgagtcattagtctggactgctatagtaatgataataatagtaagaataataatagccaccatttgtggatcacttactgcaaaccaggaactgtgttaaatccttctcatgtgcaagctgctcctttaacctgcgtggcaacccggggtgactagctgttagtatagcagttccttgcccaagtttctcagtatctttcagcctcagtttcctgttgggcaaaatagagattacgggacagtgggaacattaaatgaggctatgcttgttatgtggttagcatggtgtcaagcagggagtaacaggtcagtgagaattatagtattagctactattagcatttctccttcctcgttagtatttttccttccctgaggaggaaacagagaattaggaggaccaagctgaatataagcagtacctgagagcattcttggaagattatgctttcgtgagctcctcttagaactgaaaattgatgatgagagagacagactgtcaccaatgcatgactatcaccttgtcattattaaagcactttccactagtttatattattttattctcataagctctgtgagggccaggatttgggtcttctcttgtcccttgctacatcctcatctatatcagtggctggcacattatctttgttgacgactgacctttccttttcctctttctttgcctggcaaactgttacttgcccatcaggatccatggggacattgacgctcctccatcactctcacctccagtcctctcttcccacacaactcttagttcatacagtggtcacagtacctccatgctgtattgtatcctatctactctcctgtttgtctcttgctgcagactcctctaaggcagggaccacttttcaccacctttccatgcccctggatccttgttcagatttggcttgatgtacgcactttgaagatacttgaatgagtgaccacaaatatcttcatttgcatctgaacaattttcttgatatttgaacttcttacccaaacccccaagtccaaaggcccttgtcttgagcttacaggttttcaaagaatgctttacctgggtatagggcagctctcacatgcctgggaggaagccttggagcaaaaacaaatcgatggctctgaaagaattatgtcaacatttaattgcaagagatagctgctctgcccagagggcttccggaacaccttagcttttggtttaaagctcaattttaggtaactgatcaggtagaagctagtttgactaccgcagcttgcaaatgcaagctttggtaataacgccatagctttttttttgttttttttttttttggggacagagtctctctctgtctccaggctggagcgcagtggtgcgatcttggttcactgcaacctctgcagcggattcaagcgattatcctggctcagctttcggagtagctgggactataggcgtgtgccaccacgcccagctaggccagctaatttttgtatttttagtagagacagagtttcaccacgttacacaagatggtctcgatttcttgacctcgtgatccgcccgcctcggcctcccaaagtgctgagattacaggcgtgagtcaccgcacctggccgccacagcttcttaaaatgtcactatcaatccattctgaggctagaaatctctctggcaagtgtgtgaatgcaaaggtaatggctttacctttcaggttagttgtagataatctcatctttgttcatgaccggtgagtgccaagcccccagcattgagtatgtagtctccaagggacattttccttggaccaattgggaaaagacctggtcaaaattgaggaatgggcaatactcacctggtattttgagctataatttggttctttgagctatgagaaaaaaaagggacacgggctatgttgaagtaacaggaatttgagaagtaagggtgatgagaatctcagaaaacttgcaacagctggacatccaggtctcctggaaatgggaagttgattgaggaactggagggaaagttaaggtcctaactttagtgattgggtttctgtgtcaccaccttggcccaggagactgttgatacccccccccctttgctttgtctccccatttcttttagtgtctctttccagctgagcagtcttctgactcccactagttcaagtttctgagggagaagctgattgagcggagctgtgcattagacagcttatagatgggtgctcttaggtcacatgttcccagtgagccaatcagcagcctctagaggagaggtcacgcggcacagaatatggccgcctatgcttaaggcattacagagggcatcttcctctggaggggtagtaaatgtaggcactttcttctaaatgggctatgggtgtaacaggcattaggctgcttctattttatcagaggatggggccatgattagcccaatgaacatttactaatcattgaaatttaagcatggcagcctggtgtgtaaccattgtttgagttagcatacttcagttttcccctgttgatttagtctcatgtaaatctctgaagcctcggccagtcttttcttaaatacacgtaacagctaccataattctctttctgctagtcctttggtccacctaagttcacctagtcaaggtagacagtctgcagccactatccttcttcactttctaagggctttctcagcattgggggcttattaagcagcaagcaagtcagtcctgtaaatgtggggaagctggctccctggggtctctcttaactgttgagagtcagtggataaatggcccggcttcctgtgagacaattgtgagtcaggttccacacagctccttagagtgtccccactgggagtgagcagaaacctgatttttaatataaactttatttgtgtatctcccttctctgcctcatttttcacacctcctcacttgtacttcccaaatatattctctgctccaaaatccttgcctcaggctttgcttttgggattattcaaactgagacaataaaatactacacccattttagggaagatcaggagctaacagtgtagggaccaatgcattatggtcttcatctaaatgaagtctgtttctaatatactgaatgtttctgtaaggcaaaaactcataggtaattggttaaataggggattgtatattaatatgtagtaatatatacatatatgtatatgtataatataacatgaatataatatacatatgtatacacatatataatatatatgtataatataacataaaaatgactttggtccatatgcagtattccatagaaaattgatattttgccttaacaagaagcggcaattaaaggaatgtatactaatatagctgaatgcagcacacctcaaaagaatagagaatggtctatagaattcaaataggttctgcctcttgactcacttgccaaatcctctgtcttagaagtgcttattgagtaattctcccctatcctgacgcactgcgcctctgttgccataattcagcagattcaccctttccttataacccgtctaccaagccccaatccacattttttaaagggaaagccttatatttactgtaagttttcatttatcaacaatttatgtcttctcaaacacaccaggtttaaaaattatgattataattattatttgcaataattatgtgattacaaagttgcaaagatctggagcattctactctaatcttgtcttttccaaaatccttatgattttattgcacaattttcctaagcatagagtttttctggaacacaaatattttccagaacacctatttcagggctgctccacacataggcatatctgtgccagttagacataagcacccggctcattgcgggtacttactgagggggtagaaggaacatagtaccgcccccgcaaaaatgcaattagcctgttatcaaaataacagggagagatgaattcttatctttttgctggaaggtcggaagaggcattgggcttaggaagtggccacatcatagtcatttgatacactgtcatttgcatctagtgtaaaattcaccattgtttatcttatgattttatgagtagagaccaactgaaaaattttgtacttttattaatattatggcattacaacaccttactttaggagattcatagtttggaccctgtttacaaaaatgtaccagttatatggtatttattgagtgtctttactgcatactaggaatcatacaagagggaaacagaagttatttctatatgactctgatagcacctgtatttgtcccttttgtgttgctataaaggaatacctgaggccgcgtaatatttacagaaacgaggtttatttggcttacggttctgcaggctgtacaagaagcatggtgccagcatctgtttctggtgagggcctcaggcagtttacaatcatggtgtaaggtgaagggggagcaggcatgtcacatggtgagagagagagcaagagagaggaggaagtgccaggcccttttcaacaatcagatcttgcagtaactaatagagggagaactcactcatgatcgcagggttggcaggaagccattcaggagggatctacccccataagccaaatatctcccaccagcctccacctccaactctggggttcacatttctttctttctttttttttttttttttttttttttttttggagtctcactctgtcacccagactggagtgcagtggcatgatcttagctcactgcaacctctgccttccaggttcaagtgaatctcctgcctcatcctcccaagtaactgggagtacaggcatgtgctaccacacctggccaatttttgtatttttgacggggtttcaccatattggccaggctggtcttgaactcctgacctcaggtgatctgccctcctcggcctcccaaagtgctgggattacagacgtgagccgccatgcccggcacatttcaacacatgagatttggaggtgacaaatatccaaatcatgtcacaaccagtaggataaatactacttatttttcattcctcagatgagaacatttagtcacagagtgtggggcagccagccaacttctgatgttcagagtcagtgctgtctaaacttagctttcatgttctttctacctcagaaggctacttctcaatcaattatttgggatcagttggtttcatcacatggcattgcatcatgaatatgctgaacaaggccaagggaaggcaacaattaactggcagtttgtaggcttgtgattagatataattaaaagtcacataaagttccaaaaaatatttttcacttgtttcatatctcaacaacttccacttgtttaagttagtgtttttccaagttgcattgtgatgaggagaatttgacatatttttgagggctaagagtgagaatgattcaaagctgtgagatttgaagtgatgtctaaaagatttttttatcatgacttatgattttttatacacacacacagacacatacacacacatcctagtaggaaaaatatcaaaatataataactttagataataagaaaaatggtttctgtttacactgagttttcacaggtgagatatgcattaaaggcacaaaagctaaaagacaaagagaaatggcaatttaagcacttgaaagccttgctgaattttttacagactgtgtcaagtggagctggaaagtgaaaccacaaatcggaagctagaaaggaagcagctaggcaagagagagtaccttggactgctggctgcagtccccttcttttcccccaagtgacctgcacatcggacttcaccctgctactctctcttcccaaagatgaaatgaagaggttgaatgtaatgattactaagattctctttctgctcccacgatgatctgatgctgaggatttttaagacttctgtgccgttagaattgattacttctaaattgttatctactattcataaaaagaaaattattcaagcttgtacttcttggcacaaaatatacctgtgattttctaaaatattatctcttaatgcacaaagttctcaagtgctgtagctaaagggagctaccacagagtattaatagaaaatgtatgtgagaggatgttatttaataaacccctaagtcagtaattctaatgattcaaaatgactttaactttctactaattagaagccagactctcagctttgcttcttgatctgcacttctccccatcttggtgttcttggtgatggtcatgttcctggctgggtcactgcttccatgactgtttattaaaatcccctggccaaacagtgggcgtactggacttcctggaggggttccctggaatgccttgagcaaaacttgggtgccaaaagcaaagacctgctgtgttggagaaagaggaagagaagagttctgctgtctttgcatgtgtttggaaatgtctttctcatcaacagattctcatgcttggggatgccaggggtggtttgggtgggcactctcttcattaatagccattattgtggagtccttaaagtggattaatgatgttttttaggaaagataattatctcctatgctttccgggaggtacatgaactgctctaagattgcaagtacaaaacaggacattcgtggtgctactgtgtgaaaaaataaccagcagtaccttgacatttatagattttatataagcatgtgagtatggaccttgggcctcaccagccccagaacaccccaggcgtccttgtaccgcagggcctttgtatgtgctgctcttgctgcttgacctgccccacccagtatctgtaagccttgctctttctttcaattagaatctttacttaaacatcctctttttgcacaggttaccctacataaatcaacgtgcctcctgtctcctatcactctctgtccctttatcctgctttgctttttcttcacagcacttatttcctgacacagtaaatcatttataagttgcttattttccacctcctcctctggaatacatgctctgtgaatacaggctctctgcttgtcttggtctctgtttaattcctaatcctggcagagcacctgtgacatagtgaacactcaacaactgtttgctgaatgaaagaaaaaatgaaaaggttcacatggagatgagagccactggccaacaatttcagtcaaaacatattatttacttaaaaatgcaatgtctgcatatatttgacaatgataatttattgaaaacaacaacagtgaatacatgagttgatatctgtcttttcaatagatatataatgagcctctggattttatttttatttttattactcacgtattttttgaaacagagtctcactattatcacccaggctggagcacagtgtgcgatcacagctcactgcagcctcctctgcccaggctcaggtgatcctcccacctcagcctccccagtagctgggactataggtgcacaccaccacgcccaggtaattttttgtagatagggttttgccatgttgtccaagctggtcttgaactcctgggctcaagcaatccatcttccttggcctccaaaagtgctgggattacgggtgtgagccactgtgcctggccatccctggatttgaaaaggaaaggggtagagtgacaaggactggttgcatctcacattccaaactgcttgttttagtatgcgctaatgcatcaaccttttattactgcccagaccgtagacctggcttgttccttttcacatgttattctcaccagaagctacaaagtaggtgttatttgtattattattgctgttgttgttgttagaatacatattcctcatttacagacaagtacacaggctaagcatgactgcaacttttgaattgtcatgcagctcagaactgggggatctagaaactgaattcagcagctgattatttggttcccaataccatggtcttgctacttacctactagaaaggattctcatttgtctatttaagttcttctcctctactctctgaggaggattctttcagctcttagtgaaataaaactagaaatggaaagggaagtctcaaatctatgttcagaagagggaagaggtttaacctgggggtgggagggaagcagatagatgtgctagcagagcaagcagtttgagatctaatatacagccttagtgggattaaaaatatgaggtataatttgtgttcatttattctacagatgtattttgagaacatagtgaaggcatgatgcctggcccacagtaggtgctcaataaacgtgtgttgaataatacatgaaggacacgaataaatgtgtgttgaataatgaatgaaagacacaaattcaggaggtaattttgtttgctggtttgtgtccctttatctctttatcttgtgatgtggaaccacactcacagagtcccttcatcttcattcatttcattcattcttttttttttttttttgagatggagtttcactcttgtcatccagtctggagtgcaatgttgtaatcttggctcactgaaacctctgcctcccaggttcaagcgattctcctgcctcagcctcccgagtagctgaaactacagacgtgtgccactatgcctggctaatttcttgtatttttagtagaaacagggtttcaccatgttggccaggcaggtctcaaactcctgacctcagatgatctgcctaccttggcctcccaaagtgcactgccttcattcattcttaaatcattcatttctttgtggaagccccttagctccatgtagtttatggatgtgtcagaacaaactgaatattgtttattcttttactttttaaagagatgagtatttgagtcctctgattcacagtgaatttcagaattctatcagctaaatacctcttgaagctccgattaccaagactataagcccttctacagcattaagggattgctcgtaaagatactgctattatgcatctggtgtaaagcctcctcatctttagctcaattcaacaagtttccattcagtgcccagctctaaaagtcttaaatggaaattgattccctactccttctattttaactgtcaaaatcatagactgcattgtttccaactgaaaatccgctgacagctccccaccaaccaccccgtgagccttcctagggctggcgttgatgatgctgctatcaatggggaatctacattgtgcacgggtatttatgatgagaaaatcatgtggcataaaagagaataattgccttcataagtgtataattttttatactataagcttctcaatgaaaaagcattctaagggaggcataattgctaattttcggtgttaaacatacctctgaagagtatttcacagtctaactctctgagtgtcatgtcttcctgtggcccggggaagagagtgggaaggaaataaaatttcattgagcatctacataggaccaggccctgtaagttcttggatattggtttcttcttataatgacttgagaattacatggaattatccccattatatgagaagacagagtctcacaggagttaaatcacttctcataaaatcatctctcatagttatgtgagttcagaatgcacgtctatgctaccccaaagtccaagcttaatagagaaatctacagcaactctttatattctggagaggttttattactaagcttaagaattgaggtgccctaagaacgggctgcccccaaaatattttcctcaccacctcacttctgtttccagaagcccaacatgaaaatcactcttctgaaataagtcctggagtcttctttaggcttctgctaaaaagtcttattcgtgagatgtctagcgtaacttctttttttaagtcaaggaaaatgtgtagaatttaggtcaagatgcactgagaataatttgcaaaacccgtaaatccgtagctgatatatttaacaccaggtccaaactgtttctgaaggattgaatctcttgcctgaatactgaagaaaatggaggcatgatctgaggttggggaatattctaccttgccaaggataactgtagagtattgtgacaaagtgcaaagatgccacatggattctggatcagtcagacctgggttggaatcctgattctgccagtacacctttctgcctggttagcttggaacaaagcagttaatctattgagcttcattatctctctcctgaggctcttgtgaggactaaatgagacaatacctaatgcttcatacagagacagtggtcactctatcataataataggagccctcattgtttatgtctttaccatatatcattatccaatatattcctttatatcattatccaaataaatacatctgatcaaatcccccaaattgctttcttctcagcattcctcggtgcaaaatatgagatgtcctttgactatataatataaaatatactataacatataatattgaccttatattgaagatgtatttgtacccgacatacaatatttttagaaataatgtttcattataaaattttttacacgtacagaaaagtttaattttgcagtgagcactcatgtacccaccacctagattctaccgttaccatttaatccacgcattttaccacctatctttccttctgtgtgtctcccgtccatccactaatctacctcatgttttcgattggacacatttcaaaataaattgtagatatgctctccctctaaatacttcagcatgcatatttttcagtagagttcaatatttgcttacatattgtttctcttttgatgtaaaatttacacacagtgaaatgcataaatcttaagtgtgtattctgagttctaacaaatacacacatctgtgtaacccaaagcattgccaaaatgcagaattactgcagaaagttccctcaagcctcttccgagtcaattctgactcctaccacagcaaaagtaaccattgctctgattgttttctatcttggattagttttatctgttctagaacttgatataaatagaatcatgcagcacatactcttttatgtaaggcttccttgactcaacatgttgtttttaggatccttgcatgttgttgcaccgatgtgctttctgaatcgggaaaaacaaatatttttgtgtttgtagaagtctagcttaccctgatgccagatttaaattccctgtgccaaacacattgtgtgctcctggtccctgccccctttaacttccccagcatagtgcctttgttcatgttctttctttccatcactccctggactctggctgttcatattctgcccttcctctggagatcagctccaatcccaaacttttccaaagtctgcattgactcccttgggtttctgcctgagctctctctcctttggacactggactgccatcccattaactgttgatgttgtcatcagtgatcagctcctggtcataaactaaggaagagttaggtgggagcactggcactgagggtccatgtgctcacttagctttccagggaggggctagaccacaggtactcttcaccccacgagccaaaaggagtggatctagagtgaccattgcaaggcctcaaagagaaacgaagagtgaggagtgatggggaaagagccaaggggaccatccctgagtcatgggcgtgccttgggttgaggctaaaggttcaagagggaggagtaaagaagggaaggaaactgtcaggagtgattgctgtcatgtggaagaagcctaaacatgaagtcatgagagacgcaccttgtggctggtgggaatgctacacaatcatgcaacatgtgcctaattttctcaactaaattgcaagctgatgtcttactattgacaggaataaagtttcataaggtgttccctgcagtggcctgactgtgcaaggtgctgatagatacctgctagttgataatgatgcctctcacatggccagtcattttagcaattagtttcattgatattgtgggactgggcttattggagatttgactgaattgaccatttcagccactacagcctttgcagaatttgtgtctgtcaacctggccttcccaaggaaatggaggttaggcaataaggaatgtgttcattttattgccattttactaccacagcatggtagattccagctattaatcctcatggtataaggtgctttttatatcttcaaaaatagggtatagccttgatctctcttcttgctgctctggaattaaaatagaaatctttatccctatctcaaaatctttggggcaggttaggagagctgggcttcaggatcatccagcctagtgcttaggtctgtttacagctcagcaacatttccattggttgagggatattgttcagcagccactgaacatcaggctctgacctcttgtttctttgctgtctaacccagcagaccatcctcggttaatacttactctgattcagcctagcaaagaagatcagaagcaattctgtgtccgcaggctccctttcacacctttaatattttgtattttgcaaacattttgagttagttagcaggtctcttgctttctcttgagggctgggcacaaatgttcaagaataatcattgtaatggcatctctctgattaaaaagacagctggcaagattgagatagaacatcaaattctgaaacatcattagcaggattctattttggttaggtataatcttctgtgaggtcatcatgttgtcttcgatgagtctaaccattttatatcatttagatctaaacagacccatcatgtcacaggcaaatggctttatcatatttaattaacccaacaccatgtaataatctccctggtaattatccctcactagtgcttgaaagcgtgctgcaacaaataaatcatcaaagttgcaggtatacttaaactgttatttggtgccgtggcagaagaatattgacaagtcacagtgcaatcctaattatactaagaaaatgtaaatggcttcatcaaaaaaagaaagagccagatggcaggttttatatactgtatcctcctgtgttagaaaatggggtattaaaaaggcttcatgccctcagcatcagggaagaagaagaaataaaggctgatacctctgtctttatggaggccacgttgaacctctaattctggagaatggtaacattgaagaggacattagtggccattgacgtttatgtctcctgatgccaccctacatataagtgaatgaatattaccaggatgaatgctacttttcttatgataggaattgattgaggaggataggagcaattccatgatgccctagattttactttatgtttgcaaatgacaaattattcacagaaagacatgtgcccaccaggtggtgaatcaatgtgtttccattgacctggcttttctaatgcatcagcaagaacacatttaccggaatgcattgcaattaaaaagcaaaattcagttggaaacaatggacttaaacctacgaaatgtgacaggataagtcagagaggaaatttgatttcaatggtgagattaacgagcccatgaatgcatggtgcatacggcacagacaaagataactgaattggattttcaataagcatagagttctagatttccctgttcttgaattgtgtaccgtaccacccagctgctgtccccagctaattttgccagagctggatgtcagccaaagcacaactgtctatggcttgggaagttctcctttgagtcagattatttagttagctcaggctggtaactgccacagaacctggctgtgatttggtcttattagaaaacaaatttggaaagtattagagaatagtgttcgaatagtaatgttttcccttgctttccttaatatttcctttgtgtgagtgtgtgtttttgtgcacattgcactgttgttacccaaccaatcagaaattctgtttattataaaagtaattctccttaattagagaaaatttggaacgtaaaaaaggaaaaggaagaaaattgctcaaagtttgcagtccaattataatggttcttgaccgtttagttatttagtctttttcctttatgcatacattttgaaattgttggtttagtttttttatagtttgactcatcaaaaatcatatattcactatcctgcttaaaaaatcatcataagtttaatctatatagttacatattcaatcattatgctttgagttatattgacattccatagacagatgtcatttcatgatttttaagcagtcaattttcaattactgcataatattcttccatttggagatacatattttagttcagtattattgtggcacacttattttctatatttcctttttttctggagacagagtctcagtctgttgcccaagctggagtgcagtggcgtgatctcggctcactgcaacctccgcctcccaagttcaagcaattcgcctgcctcagcctcccgagtagctgggactaaaagcgcacactgccatgcccggctaatgttttgtattttagtagagatggggtttcaccacattgcccaggctggtcttgaactactaagctctgagctcaggcaatccccccgcttcggcctcccaaagtgctaggattacagccgtgagccaacacacctggcccaatagttccaattttttatgtgtatatttttaaaaaattaagttgtgactttagcgtgaattgaaatttgtttgactatacttcataaacccttttatattgttttataattttttgcaaacataatttttaacaatgcataacttgtttatcacaagtcagacccagaatatttagctcttcctttgtgttcattcactgaaatcaaggtgctttccagttttttacaatgataaataatactttgacttatcaattaattaaaatgtgttatatgtcaattatatacagagcactgggctaaactggttatctgtgtacataaactttccaagtttgggattgtctgcttagaaaggatatattaaattggtaccattggacccaatatgactggtgtttgtaagggtctaggtagaggctgcttgatagcatttgtaaagggcaattaatctattctgccgtcagcattacagctcgcttcaccacacctgtgcactcaacgactcttcctccccgaaagtggagacagtgaggcaaaggacatggagaaacggaggctcggagagtttcagtaactttccccagtccaccagcttgtatcggaattgggatttgagctcaggtctgtccagctttagaatgcaaactcttaagtgctgccttaagtttgcttccccagaagaaggtcctgggatgagaatttgtgttaaagtgatgtatcggaaaggttgctaggaaaaacgtatagggaagtgggaactgagtttggcaagagggagactgagcaagggtgtcatctcaagcgaagttccattgagataactttggcctcatcttccagggagactgggaatgatgtgatttgcacttcagtgctggcccctttggggcaaggcaacttgagtatttataactcttgacccacaagtccttggttaaaggctgctgggatagtgggcaggcaggggcacaagttgtcagatgcttctgtacttcatgtgttacagacaaagcagatccactagatgcagccttttggaaaaagacacagatgcccttgatgtgctggtgtcggttagcaatggcttggaagagctggatgttaaattgttaggaattttgcaatctggttgaccccactgacagcttgaaatcagccatggtgagagtatctacaccatggaaattggccaacattacaaattagggctcccttccctccacccagaagtgttcagtaaatatttactggcatactaccggagctgctggcctttgggaatggaagcatactgggggtccgtgtgcactaaaatggcaaagaaaatctaggggatgtggatggtgcagggacagcatctactgcagcactcatgtataccagctgcaatatggtaggaaacctgcccctgcccacacaggctaggcagaggtgtgtgagaaaaagggaactggtgagagggaggggaacatgctggatttcagagcaaggtctctcaacctgaggtggcctgggtatgagacatgctacgcagaaaaaaacctagaaataactgagattaaaatagctaactaagctactgaatacttgcactgccaggcactgagctagatgctttactttggctaatcttcataggagccctaggaggtagatttcatcatcatcatcctcactctaactattattatcatctttgtcatccttcttctacagatgataaaattgagatttagagaagtaaagtaatatgtctaacatcatagtgggatggctgagctctgaacccattcaatctgactccaaatgcaaagattgaataactttgacagaataggtcccacttcctatggactgagtacacatggttgtgggggcataggttgcttcagtggccatcaggatgacctgggagtaacctaattttacgtgattataggcttaaccatctggttatcaggaaaaaaaaccatgtagagagcgcacgagagcccagaatcagtagctgggcctcctggtgtggaaaggatagaactcaaatctcatcgagggatggaagtctggatacactcctttcatctctcagaatcagctccaggctggcccaaaacaaatgatacagaggctgagaaaggcagagcaaacctgggacatggggctgagccagcagaatcattagcagtcaggctgtgtgaatttttttgtggtaagagagataaatgtccctcttgttctttgtggtttcctttgccataagagccactgctttgtgaaagttcttctttcctttctctggcttgcccatccctggattgatgtagtagccagcagcaaggacatatgaagggtctggaagtggaaggctgccacccctgccctgctcccacttctgggcccccagggatcccctgacataaacagtcctgcaggaggaaataataggtggacttgtccctgtgacacagtggaggtaggtctggaagtttcctttgaacattaggtaggtctcagctttgtatttcaggtgcttttatcatgtgttttatcctgtaacagtacattctagagctacctttcaagtgtcatcaatctccaattcattttatattttcctctatgtatgtacatttgtatgtatgtgtgttcagttaccattatgaagtaactgacctgaagcaaactgaaaataaatcttgccttatgttgccaacattgcatttttttttctttttcttaatttatctgtgaatattgtttttcttcttcttcttctttttttttttaaatggagtttcacactgtcacccaggctggagtgcaattgcgcgatctcagctcactgcaacctccgcctcccgggttcaagcaattctcctgcttcagcctcccaagtagctgggattacagccacccaccaccacccctggctgattttttgtgtttttgggagagacagggtttcactatgttggccaggctggtctcaatctcctgacctcgtgatccacctgccttggcctcccaaagtgctgggactacaggagtaagacaccgtgcccggccagtattgttcttctttatacctaattactcatcattggaattctctttaaaaaaaaaatgtgcttccctaattggttgccaacagagaggctacatcatagtggttaagaatataggctcttttcccttgactgaagcagtgattaaaacaaaaaaataagaaagaatataggctctggtgtcatactgcctgggttggagacccagctcttcaatttacatctgtatgacttcagttcatttttttttttttttcatttctacatggcttggtttccccatctgtaaattgtggatacttacactagctatctcataggttattgtgagaaataagtgagtctgtatgtatgaagcccatagaaatatacataacatagaggaagcactacctagtgtcagggtctaccactgtgtattctttaggaggtttcaatcttgaccttcagaaaaagaattatttcattcaacaagcatttattgaaaatttccttggtgctcatctctgtgccatgtcctttcatatagattttatctgacataacttaattcttaccatcaccctgtgttaaagttatggtgttcattttctagggtttaagttctggaaatgctgtgtgctcactgtatccaccaggataggtgaggctctgctgcattcatgaacagtcacagatctcagagcctgtgagcgggtttaattctccttcatgagaagccccctggtcagggtgtgttcctgcacctggtggggcagcatggtgggctatcccctcctatggctcctctgttaccaaacaagctcttcctatagctgcagctgaggaataaaaatgctggagaatcttggcggttaaatgctttgacttggaaataaaatggatcagttctacctgcagcccaggagcaagattgggttgcagactctacctaatggccctagagactgtaatcctcccacgtgctggaaggagagtagaatagggtatggtgaacaggagatgtctctaccactcacttgggactgtgagcacctgtctatacctcggctgtcttatctgtgaaatgaggatgacagctgtacctactgcatatagttgtgatagagtgaatagataaatgcatgtaaagctcttagcacactatatggcactcagaacatagtcaaaatggggtcactgtaatcatgatatacaagaaagtcagcggagcctcctaatacagtaaagtaaccattgttttgaatagtcacgtgtggatatcaagtccagttatattacttaccagctgtatgtatgagcatggggaagttatttaccttctctgacttttacttttctcttacgtaaaatggtgtgggatcacactcaccccataggctgcatcaagggttaaatcgctaacatttactgacaccttggaaagatgagctaagcgtttaaaacctgttggctcatttatgtctatgtcaatgctatgggaaaggtactctgttatcccccattttatagcagaggaaactaagcctcagagaggttaagtaatgtacccaggcctctctaactgctaagtggtagagcaaaaagtgaaacccaggcattttgtcttctcaattaatgatcttaatacgcattacagcctccctgagatcagttgggtaaagctctgagcacagggccaggcacagtgtacacccttgcaaaaatattaatttgcctgggtgcaaggtgagggacatatccttttcctattctgaaactctactctgcttaggatgcatactgatggctctttttttgtgaatggatggaagtatgaaaggagcagtaagaaagggcactatcaggctgcatgcagtggctcacatctggaatcccagcactttggaaagctgaggccagcagatcacttgaggccaggagttcaagaccagtctggccaatgtggcaaaacactctctctcctaaaaatacaaaaattagctgaggacagtggtgcatgcctataatcccagctacttgggtgggtgaggcatgagaatcgcttgaacccaggaggcagaggttgcagtgagccgtgattgtgccactgcattccagcttgggtaacagagcaagactgttgaagaaaggaaggaagggatgaaggaaggaaggaagggattaagggagggagggagggaggagagggaagaaaaagaaggaaggaaggaaagaaggagagaaaagagaaaagaaaagaaaaggcactatctatgccatatgcttttgtgagactatcaaggcctgcatgcaaaaaaacccagtgcagagttggtggtcaattagctggagtgctttattatttttaataatcagccatgcttagtgggagtctctgaatctgtagttatgactgtagtaaatgggacacaaagggagcagctggacataccggcaagtattataatgtgcagacaacctgcaaatatgaaccttcttttcaaataagaatctcagtgctgtcactatttgttttaggaagtgctggttttaactgaatgaggaagttaaacgcatgttctgttttttgttttcattgcgcccacatgggttgactgtgggttcggttttctctccagattgaacacttagtacttaatgggggaaccaccttggaaaagcagaactgatttgaggtggcttcatccctctcttctcccaccagaaagagatgggagcttccacttcaacctggggtgaagacagagaacaaggtgtcccagcattttgcacagaaccaaagccctggaaattctggtggaagctagacattcagagtcatcaagctaacagtcacttcctgctatgtgccagatactatgcttttcacagacatctcatttacatttcccagaacatcaggttggagtgcagtgacgtgatgcaatcatagtttcctgcagccttgaacttctgagttcaaatgatccttctgcctcagcctcccaggtagctaggactacagacatacactaccacacctggctgagtttgtttgtttgtttgtgtgtttgtttgtttattttgtagcaatagcatttcactgtgttacccagagtggtctccaactcctggcctcaagcaatcctctcgcctccactttccaaagtgctaggattacaggcacgagccactgtgcccaaaagttaagattcttgtagctgctttatagaagatgaactgaggatcaagaaggtgagacttgatgtgagtcagatagtgaatatgctatagaaaactaaacccagttcctttggggacttggaatttggcatcaatattgtcaccgggctttaattttgcttaactccacactgtggtctttgtgaatggtgcctccaagagttgtgcccctgggtgggcctgagctgaaacatcaggtagatgcaataggccttgtcttttgtgacagttctgtaccatcgtctataatatatctgtattagtaatctatggttatacaacaaatcaccccaaaacttagcagcttaaaaccatatttattattccacaatttctgtgcagcaagaatatgggtgcagcttagctgggtctttgggccataatcaaggctaaaatcaaggtgtcaactgaggcagcagtcatcctaagacttgactgggcatgggttggctcctgagctcattcatgggattgctggcaggattctgctttttcaggctgctggactgagggctttgcttccttgctggctattggatggaagaaccctttaattccttgccttttggacagctccagagggaagctcacaacaggacaacttgattcgtcagagaaaataggtgagaagagccagaaagccagagggccaagaaaacagaagccacagtttttgataacagtcatagaagagatgccctgacacttttgttgccttctatgctttagaagcgagtcagtaagtccaccccaccctcagtggaggggattacacaaggacatgcatatgaggaggcagggttcactgggagccagccactgcctactacaagaaccgtgattattttaacgcaaaatgatgggtcaaattccttttattgggtagaattgtccctccagaaaaatctcttttgtcttgaatattcatgcatgctctggtacctctctttctgtgataaggacgttccagtttgaaaaacctgagtttattagtcaaattgtgctggtgtagaaatattccctctctttcaaataactttgcatccacctgctttgactcatgatgttgaatctaattttattacagagttttggatggtgggggcatttccacgttgctgctatgtactttctatacaaataagtgttgacctttgaagtagtctccctggaatagaaggttttaaactcattgatgatgcaaactttgcttaagaccttgttgtagcttctctttgggaatggcctttggaatcacgaccagaaaaaaaaaaaaaaaaaaaaaaaggtctgctttatctattctcactacacagcatttattagatatggctgccagggagatatctccttcctcactgattgttattctatgcattttcttcctaaaactagtagatttgaactcatacctatctagagccctcattatgaacaacagctttaaagcacgcaaggcactaggaacccctatttaatcatttacagaaaaaacatggcaaagaccaccacctccttccttaattccatggtggatttaaaatgcttagattagctgagtcttaggaactgaagtatccttggtgtttcatttgtgataattttaaatacaagtgttggtctgaagaaaggaaatgatcaggaattagccctggagcctgctgtgtatattaaatcaatctcagatggaagaattgagatcccggaaagcaaagaaatggctggacttagagaggaaagataatctagaagtgtaaagttagggtgggagggagaagggtaaagcttgagtaatgagtccactgaaaactattttttaaatgtaataaatacgtaagtagcagttactgtatgctagatatccttctaagtgcttgacaaatttactccttagaagctaagtactattttccccattttctagatgagaaaaccgaggtgtagggaagttgagggacatgtccaagatcacacagatagtaggcagtccagcttcagaatctgtggtctctaccagtgcactttgccacttcacagaactatccagccagaaagagcagaggccgctttgagaatttctgtgcaggtccaagcgtccacttaaatcagggctcctaacacagcagttctccaatgtcctgtagaaaacattcttgttcccttgggacaagagaaatctgaactcagttgtgcaaaaaagagggtctgggaatgaaccaagagggatggtcagtggctccaaggggcggagcgggagaaggcaaaggagaggggccaggagagaatgccaggaaaaaccagaagaaagatttaaacaaacctcataatttacctgtaaccgacagctctccttggatagtttatctgggcactctattccaccagaaccagattgttggagttgtttcaacagaggaatgcagagcttaagtgtgtctgtgctgtgtgaatatacctttgtgtatctgtgtagcaggtagtggtagaaagattttggaagtcgagggagatgactgaagtagagggaaaggtgggaggtcatggctctcatagtattttgtcacgaggtaactttgacaacccctgagaatcgatcagtcccccaagaagtcaaatacatctgcacatgtgtatcatgttactgcatcttaccttgacaggcgcactttaggggatgcagtctctgcccttttgtgccaggagcaaatccattttgcccatgatttcaggtacacaggtgatttcgccaaacaaaacaagcacagctgaaatctgtgacttaaatcaagcaacggtgtctgcaatagtctcattgcagagacttctgctcccttgttgcttgtaggaatgggggtggggaaaggtcaggactatatatttaagaaaaaaaccccacatatgtcgacccacaagtggttacaacaacattggtttacttgaaagctctgtctccactctccctacaaaaattcaagtaagaacctggaatgcaaggaggtggaagagttttctctccttgccaatctctcccttgctctctgataaaaggtgcggcaaacagggtagaaatgactgcacgggaccagaggatgtaaatattcagtcatgacagtccccataggataaatgacagcagcccatgcaatgtgccttctgcacattttcaactgactcttcccctctgcagccaagttgacatattagtaaattgattccaggtgatgctgacattttgtaattatcactatctataattttcatcttatcccatttaatattttgatcatttaaaatagagtagcatacctaatagtggtcattagtttagctcaagggaagattcatggtttaataaacttacattagaaataacttactaaaattacaattggcatgattagctacttttttaaataaaacataacagagtgactttacccatgctgacagcttttttctttcacgctggttcattgttctattgttgtcttggaggaagaaaagacatgtataacacagaagttgtaataaaaactgtaataacccgatacacaaaaacaagggttatatttcattctacatttgacagtagctgagtagtgtactttttcttgttttctgactggactggagggaggaaatcactgtgactttgaatcagggtcacatttggggtagctgtcctcttctcctgctgtctggagagactgtgaggttgcctgaaaggcagtgggatttaggcttgacttccttatttccctaggcattgattttttttaagtgtatcttctgaagtttgcctctaggttcacttgaggtatcatttctgaagaataaaagtggcagttttaatatgcaggcaattttttaaaacaatgaaatagagatgtgattattgccagggcaaggctgtttagttgccacagggaaacattataccaattggcctatagcttgaaattacagcattctctatattcgtccagctttagggaaatgcagaccacaagggtcctgcctaccgttctgcttgctggtggttcaggttttgtgaacttatacaagggcttggtatttgaatgctatcttaatgagaataagcttttttgttgtgtacattggcaacttgatggctaaggtcattctccatccatttgtctagctacccacacacctatacatccatctacccatctgtccacccactcacccatctattcacctatccatccacccagctatttatctatcatccatccatccacccacctacccacttattcaccaatccacctattaatctatccatctacccatccattcagctattcatctacctatcagtccatctatctattcaacctttcacatatccacccacttacctcccctctcatccatcaatatagccttgtatccatccacgtaaccactcatccttaaacaaaaatcagttggcaaaactgtaagcattggtaataaagagacatataagtcgcagttctgtccttaaagagcttaggatctagtacgggagtatatgtaaaccaaaaattacacaacagtgtgctcagtgcacctacagagaactgtgccgtgttgctgtgggaactctaaagaaagaatggtttactgtgtctgaaggattcaaagaaggaggcacacatgtgaacctaaatgtcatatgtggtaaaagaggaagtaaccagccaggggtgaggaacacaacagcaggaaattaagtagctgatgaatattcagacttgaagttcctcctaaagtgcccatttgttgtttggtagaaatatggatatgtaggagggggcctctaccagggtgcagaacatatggtggtattattagggcaccaggcaggagctgaagtaggggctcagaaagccaatcacaagaaccaggattcagggtgggcctgtggttttgaatggaagaaaggagaaaagagtaaacaaatgggctgggcacaatggctcacgcctgtaatcccagcactttgggaggctgaggtgggtggatcacgaggtcaggagttggagaccagcctggccaacatggtgaaactctgtctttactaaaaatacaaacattagccaggcaagtgcctgtaatcctagctactggggaggctgaggcaggagagtcacttgaactcgggaggcggaggttgcagtgagccaagatcgtaccactgcactccagcctgggcgacagtgccagactccatctcaaaaaaaaaaaaaaataataataaacaaatggatgcatgaacaagtgcataataggtagataaatacaccttaggagacagatcaaaatgcagacttgaatttaattggcacagacacttaattatgcatcttgacatctttgaccaaaaacaaaatgccaagaacaaaagcagcttcacgaccaagcacatgctggaatccggccttctgtctgccttactcccgctgctggtgaagctgcaggaatcctgacaggagcaggctgcctttcagctccaagttcctggcactaagttctgcgcaggggcctgggcgaggtctttatgactttccagaggcttccaggtctctattgaaatgcaacagctgttactaggggcaactctacttcccaaacaagaacatagactttgtggagctttcccaggtgctgtgaacccagcattgccaaacaatgcctgggacccacagcgtctccttcccccatggagtttaaatagattggaagcaaatgcttgttgacaacaggtgtggctcaatgtgagcaaacgttccattccgttattgcagggttggcaccgagggacatttcctgtgaaagaaacaggcttccaggagcatgggcaatccatactcatagccagacctgctcagctcctccccttcagggccaaagaccgcaaagctccgtgaacaggtgctcctaataaatgcagagttttccatagcccaagcaaggctagcagggaggggaggggtccctggccacaaagctccaaccagccaactgatcaggctttctgcgatgatggaagtggctgcatcatcattaactcagctagattaacctgttcagcagaagcttgcagagctgcgtgagcctgccttccactcagcttgaattaaagagattgggctgcaaggacacagagaggtgagccccaggaggtggggtcccagtcctgagattagtgacagcagccctgaggatgtagagaaaaacttcttactcctttgaaaaatgtgtgcagtgattcttttcctccctgagctgtcttggagccaaagtaagttcttcacggaactaaatggagttgcttgttcaatgagattctaatttcagtgagaggacttctcggctacatatgtattgctttgggaagtcctcccttccgaggcaagggcttctccacacctaggatttgatgtagaattactagggcagtatgtaaggacagagaaagaacagaggcagcggcaggcttctgacaagggaatactggtaatcaggctctctgcataatttttggagatttggagatggagttagtggagggaaagaaagaaacggatataattagaaaaagaaaaaaatactaatgtcttcacaatacttaatgttagaaattcaatttgtttttttcttctacctccgcaggctctacatgttcctggaggtgtgtgtggctgggcaattatcctttttcactcttgcccagtgcttgttttgaatgcaaatgtattagttcagatgggccaagttgcagtaaaagaaatccacccccaaatttcggtggtttaacagaacagatgttcttatcctgcttacccaacagctctagtgggtgtttcttctatgaagctgctcagaaactcaggctgatgggtgaccctgccattttcaacatctggtcttcaaagtgaccttagacgttgacatccctgtcggccagaatgcagaagtatcacggcgcagcatgtgggagaggttcttatggactgtgcctggaagtggcagacattgtccccatcacttggtcaaatgaccacacctaccagcaagggcaatgaggaaatgtggtccagctgtgtgtgtacaggaagaagggacagcgaatgctctcccccacaccctgctttcagggtttatccttgtcatttattgagggcctgctatgtgccctacattgtcctaggagctgaggatacagctgtccacagaatacccacggtccttgcccacacatggttagaacctagtgagggaagaagaagaattaatacctctttataaaattaattaattacactttggataagggtcataggggaaaacttcagggcaccatgagagctggtaactctctctatggtgaggtgaaggggaagtagaggaggtttctgggaaacagtgacattcaaactggcaaaaagaaagcaaaacagacttaaccaggcagatgcacagcagggtggcattttaggaagtgggaccagcagctgaaaagtccttaggcagaaaataatttcaaacattttagacccttcctccaaagggcagcgaggctgatgcacattgaagaggccagagagcgccttgaaatgagacagaagagctgctccgggctgagatggaagtcatcttcctggactcagacagttagggctactccttagcagtagtgggggcccgctcatgggtgtaagaaagaatgtagcatgatcagctgtgcttgtcaaaaatctgctctgcctgatgaagtctgaaggagggagggtactgcagtctttcaggggagagacgggggcttgcgttcggggctggcagttgaaacggagagacataagatagattgttgaaataggaaggggaagacatgagactctcttatgtctaaatgtctaacatgggttggaaaggctgcccaccagtcccaggtatgcaggcttggcacttggctcatttgaaagagagacaactaagccataactggtttatccttttcctctgcagttttatggccttcttgacttcaggcctatttaataaaatgcagctctttaaaatggatgttcagtggagctcaaattcaccctcaatgtgcacttctgcggactttgattagtatgcataatagagcagcacacctgatgtccgcagcaggcagttctaatgccggtggagagaggtacaagataaatcactccaagtaaatgactaattaatcatgcacttgattttaataacatataccatctggctcaagatttgtctgtctacaatcttgtattccattctagagatttgataatcagtaaaaccacccatggattcctaattgaggacaatttctttcctttcttttagaaaacttaggaatcaaagtgtattccagtaactgcatggaaggggctggagggagaaggttattgttatatataaagtcgcggtaccgcaaaagaaatagcagtcgaatataaaattttatttttaattctcagcaaggcaagttacttctatatagaagggtgcacccttacagatggaactatggtgagcccacatttggacaagagaggggaaggggttcttatccctgatgcacgtggcccctgctactgtgtggttcccctgttggctagggttagaccacacaggctaaactaattccgactggcaaatttaaagagaatgatggagtgagtgctttggcaggagtcaaggcagagcaggtagcaagtaatctgaatgagttagggtgagcaagtgatcagaatgagttagggtggagcaggtgatcagaatgagtcagggtggagtaggtaatggaaaacggttgctttacgaggaagttaagtttagaagtagaaggcaaagaattgcacatactgacatattctttgaaaagaaatttagaagtcatatcttacagttaaggtttgattttttttttaaatcttaaaaccatcatagatatttcaggataatttatgggacaaaatggacactatcccaatgaaaacgtgtaaaatcacttccaaaagtgtctatgccagagggcttacttgcaatgatcctttgatcctccaaatcagaaaacagttttttttttttttttttttccatagtctcatctatgcctttttggtttttcttcttcttttgtgtgtgtgtgtgtgtgttttattatactttaagttctagggtacatgtgcacaatgtgcaggttttttatgtatgtatacatgtgccatgttggtgtgctgcacccgttacctcatcatttacattaggtatatctcctaatgctatccctccccctccccccaccccacaacagggcccagtgtgtgatgttccccaccctgtgtccaagcgttctcattgttcaattcccacctatgagtgagaacatgcggtgtttggttttctgtccttgcaatcgtttgctcagaatgatggtttccagcttcattcatgtccctacaaaggtcatgaactcatccttttctatggctgcatagtattccatggtgtgtatgtgccacatagaaaacagttgtttttaagggtattggacaagggtcatgactgcttagcaaggaagcatcctctacttgtgcatggcttcaaacgcttctaaattaacaggagtatgaaccatctgaggattcacaatttccagtgagtcttggctctacttatttgaaatggatagcttcctaaagtaacatataattcacctataaaatactattttatctcataagacaaaatgagtccatggtcttattatgtaagactgttttccattggggctggtctcaggctaggcaaggtgagtatctgtaggtggaattctcctgagaacagatgctctaaactttttaaataattgatttgacttcttcaccatgtccatgtatacagctgagcatggccaatctactggtttgtattatactgtcaaaaaacaaacaactttccctaacaaaataaacagtatctcaaacagcagcacatatgtcctggggggtaaacagaaaacttgtcccatttgactcatttcattatttggaagaaatttccgtcacagaaggcagatgtcggtggactgataccagatagtagagaaattctgagtgtttactgtgtgcaaaaaaatgctgcattggggggctttaatcagaaatccatgaaaaatagtgtaagtacaatttatcgagcatttattgtatgctagacatatgcatcacctcacttcagaattagcctatgaagtagaattattattgtcctaaatggacaggtgggacctaggttgcccagagaggtgaatgggctttcacagggtttcacaaccagtgggaaaaggctggactcaatcccaaattaggctcattaatcatgctcttgattttaataacaattttgtttgttttttctctagaaaagttacgaattaagttgtattccacggactgtatggaggggggtgaagggaggaagtgtgtgtgtgatctcaaaagccatcatacatctttccggagagtttgaaaataataatctgaaaatccaaaggctgactcacaactcctgggctgtacctacgatacagtaagtaagaggatggtgtcactgtgtcctcccttctgtcctgaagcattccatgctacacaccattcataagatttaaaatcatcttcaagaagtgccctgttggaataataagtcagtgctctctggaggctataaccaaatataatttgccacataaacatgaaatgtgtgtccaagaaactagtaggaatgcatctaggaaccaaagtgtctccttcctagagagagaggaaaaaaacaaagtgaggatggtcctctgcacaggcgttgtatattttgttctcaaatccagcagccttgacttgacatgggatggttgggatggttctccacgtagccacataagctcgttactacccattacatctgcctgtacctccagcaggtgcccaggagatggctgagtcccaagagccatgcaggcctcctggacgaccgccctgatgtggtccacgtgactcttaacaggtatcatggccttggcacatgttgggcattttccagcgtcactctcagaagaccctccctccatgagttcaccactgctggtctttaactctcagcttagggaatcagactgaattagttctttgtgttattaaccggaggaacacttacattttctgacaactctaatcttggagctcagggaatagcacagagcatttgtatgaaattacccctcgttctatctataggcctaacagccagcatttgtgaatttggcagaagccagcagatctcacagttaatgtcttcctctcctgccaggatctttggaacaaggtgcttagagtgccacatgacaaagagccggacagatcctgggatgtggagcccaggtgatgttatttgcatccaattaaagaagcaggaatgggtagcataattgacatgcatgactcttaatgccttttggttcattaagcctttggatcaacttttgtaggaagacatttaaaagaaactgagcaggacttgggcacaggtagaggtgagcttccgggctgaatcccctactaggccgttagtcaattgtatgtttcctttttggactcacctctgggttgcaaaggaggttgctctgattgtttcttgttataccataaagataaggagcttgagttactttccagctgataaggcaattttcacctttttccatttgtcttggaatttcacaccccaccccatcctacccttaaggtgccctggaggggttgaagggccattcttggtcatccagtctctgtgtggttgggttgatcacagaaactagagaagtcacgaagagtaggtgttcctcaggttaattacacaaagaactaattcagtctgattccttaagctcggagttaaaaacagtgattgtgaactcatgaagggagggtcttctgagagatataaagaggctgatatatgctctttatatctcacctttgatgatacacagctcacctttgatggtcactctgaatcacatcaaggcgatgacaagaacaactgtctagacttagtggtgtggctttgaaacgacacttcgccattcagggattcaattgttttccagttttataatgagggagctgagcaagagaaatattttcaaaggccattctgggctgcacaaggatagaaacaaatgggaggtccattgggcaggacacacctgtttctacaagagcaacctacttttttgttttgttttaatcaagggagtgtcaagcaattgcttatttcataaacagggctgtgctgctatttttacacagtgtgaagtccacaggtctgaataatttcttcttgctccaagagttcctaggtcctgtgttcagattttgagagccttcatgtctcaggtcccaatagcagtttctatgactgaccagcctgtccacagagcatctcctcactggacaggcattgtgggcacgctcctgcggaggaagaatcagggtggtgaggcaattagtaggtgttctacaatcctgacatctttctcagaccagcccccatctctgtctattggcgagatttcttctttagcttctgctcactatgacatgaaggacttcttcttacctagatattctggtgctataggggggtgctgatcagtggagcttagaattactttacacacacatgcctacaccccccctcgcaacacacacacgtaccttacaaaatttctaattataggccaggcgcggtatctcatacctataatcccagccctttgggaggccgaggcaggcagatcatgaggttaggagttcaagaccagcctgatcagcagggtgaaaccccatctctactaaaaacacaaaaattagctgggcatggtggtgtgcacctgtaatcctaactactcaggaggttgaggcaggagaattgcgtgaacccgggaggcagaggttgcagtgagccaagatcgcaccactgcactccagcctgggtgacagagtgagactctgtctcaaaaaagaaaaacagaaaaattgctaattatgctgattactttagataaacatttctcaatttgggcttcaaggcatattaatagacatacaaaaaaattatttggtcaagtgaaaataaagcatatcctgcgtcccatagtagggtagtgtattagtcccttctcacgttgctttaaggaaataccggagactaggtaatttataaaggaaagaggtttaattgactcacagttcaccatggctgggaaggcctcaggaaacttacaatcatagcagtggcagaaggcagccatgattgtttaccaggcagcaggaaggagagtgccaagggaagagggaggagtcccttataaaaccatcagatcttgtgagaactcactcactaccatgagaacagcatggggaaaactgcccccatgattcaattaactccacctggtctctcccttgacatatgtggattgtgggtgagagacaggactagctggatttcctaggccaactaagaattcctaagccagctgtgcctggtggctcacgcctgtaatcccagcactttgggaggccgaggcgggcagatcacgaggtcaggagatcgagaccatcctggctaacacagtgaaattccgtctttactaaaaatactaaatattagctgggcgtggtggcaggtgcctgcagttccagctactcgggaggctgaggcaggagaatggcatgaacccgggaggcggagcttgccgtgagcagagatcacgccactgcactccagcctgggcgacaaagcgagactccgtctccaaaaaaaaaaaaaaaaaaaaaattcctaagcctagctggggaaggtgaccacacccacttttaaacacggggcttgtaactcagctcacacccaacaaatcaggttgtaaagagggttcactaaaatacaaattaggctaaagcaggaggtaaagaagtagtcaaatcatatatcgcctgagaacacagggggagcgacaatgatcgggatataaacccaggcattcgagcagggtgtggtaaccccctttgggtcccctcccattgtatgggagctctgttttcactctgttaaatcttgcaagtgaacactcttctggtctgtgcttgttagggcttgagctgagctttcgctcaccatccaccactgttgtttgctgccgtcgcagacccgtggctgacttccacccctctggatccagcagggtgtccactgtgctcctgatccagcgaggctcccattgccactcccgactgggctaaaggcttgccattgttcccgcaaggctaagtgcctgggttcgtcctaactgggctgaacactagttgctgggctccgtggttttcttctgtgacccacggcttctaatagagctataacactcactgcatgtgccaaggttccattccctggaattcatgaggccaagatccccaggtcagagaacaaaaggcttgctgccatcttgggagcggcccgccccatcttgggagctctaagaacaaagacccgcccgtatcatggggattacaattcaagatgagatttgggtggggacacaaaggctttcatggtttttggcacccgctgctgtcccctccttttgagtgtgggacggatctgtgactggcttctagcccatagaatatggcaccttccttcacataaaccatccatctctgagccatccccggttccttgacttcatagactcacaattccagataagagatgattctaccaccttgctgtcctggcatcccgggattcctgccgcgtgggctgaactgtctgcctttcccagtatggaagtcatcacttactcattcaatcatttagcaccctttctcgcttgcttggaaaatacaaggtaaaaaacacactagcctactatttgatatttgtgcgtgggtgtgtgtgtggggcgtcatatatccctcttagcatctgataaaaaaaagatcaattcattacccagaaatatgtatctgcatgtgtgcaagtcccaatacacaattcagtacaattctgggggttctggactccctgaggaccatttataagttctctccaagtcattgaccccaggtttagttgcccctctagactataaggccccctagatagaaggcaagtgtcatatgccactgcatccccaactctgaggacaaagcctggtggcaggtggaccttcattcagggtgaattgagctgaattcggtacatggctctgtactcagaaggcctttatttatttcttgtgttcctcttatcttgtcacactccaaaatagaaatgtatacctctgctagttgaatgactgtttatttggaaatcatcacccaatgcccaactgcatccaggctgcgtgacatcattccagactacaaagtgccaagcgctaattgatttgtaagaaagtccacatgaaatgcctggcactctcccaaaggcacccatgggcttggagggacgacagcattggactgttatgcgaggaaataattcttgcttgcccgcctgggatggggtgacgttctggccaggaagcagaagcagacttgactttgggcagcagtctgcccctgatggagttattcacagatggctaagttaaatgcagccctcatagcactaaggcatttcaggggcgactaaacaagtggcccatgaaatggaggcaccagaagcctctggaagcggcatcagtgcatcacccagtgaagccattgtgtcgcctgttagtaatgagcatttgcaagggcagcatggggaatttcaatcaacctgtgagaagacaaggtgtgcagacattgtggatctgagcgagatggggagaaaaggcaataaaaagcagtagcaaaggggaaaagaaaagttcgggccaggagccaagaagatactttctgtggaaaagggagggaaaaaaaaaatcactccacccctcctgtccaaatgaaaaagcatttaattgaatgttctttatagaggtgaaaaaataccctgtggagttcccagtgtttcattatccgattgagttcggtacctcaagtttcaaagaccgttctcctgaatggttattctcatttccatgtcagtctgccgtgtgcttggtgaacccctgctgggccgcatcatttaaaactcaaaaccctgaaagtatttttatgcccgatatagtaacagagcaaaccctggtatcactcattttattctccgcagcctccttcctcttgtctgtgatgtagatgactgtgctgctcgagatgcttgcaatcaacagggcgctccccaagctctgaatgaggtgaatggcctcagaggaaaacagattagaaggcttagagatgactgcatctcaggtgcaacacttgaagcaggaagatgggagtctcagaattttccccttgcagttagaaaaatatgggacaggctggggcagtaggagtggatttaagtaagtgagacagtggatcaggaaaggccaggcttttactgggtggaaatagcctggatgcaattatctgctacaagccccaccaagaagagcctccctgctggaggaaagcagaaagggaactggggtataaccaagcttgtccaatccgaggcccgtgggtcacatgctgctgagggaggatgactttgaatgaggcccaacacaagttcgtaaagtttcttaaaaggttatgaaatttttttgcaattttttttcttttcttttctttttttttttagttcatcagctgtcgttagtgttattttatgtgttgccaaagatcattcttcttcttccactgtggcccagggaagccaaaaatttgaaaacccctggtttaaatcctctctacaaactcgccagctctgcaaaataatcatctttgttggtcttaagaacactttaaatcaggtttaaatcatctgaacatcagaaaggaatttttttttcttttcttttcttttgttttttttctcccttgagagggaaatctaggggtggagtagagaatcatttaaaatatttcccttcagagaccaacggctaggaatagctgataaataacataaaagagcggtttaatagtttcatgtttgacccatgtaataccccgcacatttggttaatttagaaaatatttgacgacaacggaatccaatctcattttctcaaacagaagcttaatttctctttgactgaaatgaatagttatgttgccatgccttagccaaacaccctataaatataataccccttcagccttaatatttcaaaaactatggttttcagtttgagctgttataatgttttatctcagaagttgtagaataatttaaaccagtttttcctactttggttccttggaggctgattcttctgcctgaattcctctcacagaacatataaaccccttttacctccctcactggcacaaaagcaacttgtttccaagattcaggacttaaagaaatggctgtgggttggtctacgaaaaccattatgctgcatcctcccagtcctgagagattctgaagagaagcaggccctggcttcagagttgaagaaatgataccttccctcctttgcctcatagtctcattcatgatgtttgcttcccatactcatctccaactggctcacacattccttcaccagatagtgtgggaaggagtccatctttctgcagttggctaatccaggtgttggcatggaagttttagctctggtctgagagttctagtcatggacaattgtccatgtctattggaatgaataattttccaatggacatggacagttgtcccaggggactggaaatcaagggtgctgagtaaactcagcctcagtggaccacctgtgtgagttaatacagagaccacattctgcatcttagcaacctaaacaaaggagaggcacagcaaggtgagaagcttcaaaaggcagtcagccaatgcatcaacctgggcccggaggggtcggggaacctcaaattgtcatccttatgtaacagtgacaactaacatttttcaaggctcgttaccatgccctggccacctgtcccacattattttatggaatgctcagtcaaccctatgaattacatactatattatccccattttacagactacaaaatgaaggtttaaggagaagcttacacacctcacccaaggtcctacagttgttaagtagggggacagagacctgcatttatctgtagaccctccactcttaaccaccctattgacccagttcctaatccagctcacttctgagctctggacgtccaccaggaagaaaacaatggctgtagtggtgcagtgacccttctttgccagtttgtcttgggtcctgatgagctgccaggctcagtctggaaaagtgccctcaatccctgcatctccatctctcataggcattgtgggaccccacaaagactctgtctctattcgcttaacacagtggaaaaaaaggccacccttcattctttttttttttttttttcattcaacaaacatttattgatcttctaatgttttttcaagaatgcttttgggcctgggatacaaactaatggacccaacagatgagtcccttgccctattggcacttactggttcatgtcaggttcctgtgcctctcctggagaagcaggtgataaggtctctgtgttaaaggaggaaaccaaggttctaggcagcctcgtgggtaatacagccagtaaattgcaaagctgggtgaactcaattgacaggactctagccagaaactggttctttgccattagtctctactgacccctatggatgtatggagggagtatggggtacctgggaaacatcaagccttacctagaatcatctttccaatctcgctcttctcttccatttagaaccaccttcaacatctccccagggtacattccctaaatagccccgattattcattattttatggaactaccagatactgaattcctgttctgggccatgcactctaggagctgtgatttcaacagtgaaggaggacagggtggaccccaccatcgtggaatttacattctaaagggcacagtttttctgttgagtcttcccaggaggtgtctttttatttcatacctttgaccttcagatccattcatgatactttggcttatgggtgttccacacttgattccaagggtgatattccatatgtgtaatgcctcgctcaatcagaatggacactggccctagtggccacccaagatggattcttggagcttctttgctgtgacaaataatgaccttttagttgacgaattataaggaagttatgggagatcccagaggaaggctttaagacaggggaattcagagagcttggagcagcagctctttacgtagggccacagtgtatttcagtgtttctccaacggctgcacctgtggacctatgtgtactgggagactattgactctgctcagattacatgggtaagtttgctccttacaactagactgaatgcccattggaggcaggatcctatcaactttttcttctgccaaaccagcctgacacagtatacattgcatacgattcttccatgactatgtacttgtcatgagttattcctcatcattctaaaatttgacctcaaagctgagcaaagtctagatgaaatgaggttctagtttttataataatgttcaatagtttttcctatacgtcactctttcagtgtggggaggaatggtgacttttcagttgcttctgaatacggtttgctgtacactgtgtgttaccagtgtgatttgctataacccagctcttggagcctcatatggtatgtggttcaacagtacagtggtcagtcaagaataaatacagagcaagtactacggtagctgcagaaagagcatcgccaccatgcatcattagtgcagagccctggaccaaaggactcgagctgccgccagacctttacccattccaagtgcagactttgctaattcatcactgccttcctcaagaccccagcaagcttctcatcacatcacttttggcacttatctgatctttcaatgatctgagttagctcaagaaattacatctagttaccataccatgtcaagactgctatttaactagaaaacaaagagacttcctccactccatgcaaacacatgttgattctcatttacctgtttaggaaaaaaaaatttagattcaggctcatatactaattttattcagtgcttaaggtatgtctgttatttgggatagaattcagtgaacaatgctaaggtttacaagggcccatgtatgactttagggccgtgtgtgtgtgtgtgtgtgtgtgtgtgtgtgtgtatacatgtgtatgtgtacatacttttccccctgtaataggatttctttagatctgatgcttaataagacagaaagacaccacagccttctcagaagacctttgcaatatgtccttactactggtttgtgctttcaaagttcatgtgtgtagtggtctctcctgtcaccacgatggatccagatttaagatgtcattgagccatcacaaagtaaagagacactttctaccccaggttgctctggggtgagaaaactttgatgactaaactaaaggtaaaatcaattgcagatgcagtgtctgaattggatatgaaagaaaagaggctggcatttattagctgtctaccggaaaccaggttgctcttgaaacaccgtctcatttaatcagaaaaatgaccgcttgcagtggatatcatcctctccagtttacaaatctagaaaacaagtacatcaaagcagttaagcattttcgtaggagccgcacactcagtaagctaatattagaactcaggtctgtctgatttcagagctctttccacactacctaaaatattcatgcaccagatgaaagctttcttttttcccctagactgtttcttaaatttgtagttctgctttcaatacagggtttcttgaaatgtgatggtgtgattagacttctggttattactctccaaccatcatttctaagagaattggtgtgtgaggctgaagggatgatagtagggtgagccgtaaatacaggttaactgtcttaatgtggcctgggcaatgtctaattactcagggctgtttttggaagacacttccccattctaggataggggttacaagcacaaatgtccataggagctgggtagttactgtgaataagtgccataggctagcctgtttgggtttggggagctgagtgaggctgtactgggaaacacatgccccaggtagagctgggggttggtgtctttgctccgttaagacgattgcaagatcccagcaagggatcttgaatatttgcaggttctgggttctgtgttgagtgcttaaatggatatcttatttaataataacaggaacccttggaagtgagcacaggtttgattctcactttgcagataaagaaactgaggcccagaaaggtgcccaaggaagcagagttatttaggacctgacagaggtaggattccaacctgggcagtctatcaccagagtccttgtttaatcactaaattttgtacctcttaggactattcaaacccagcaatttgtctctgagaatgatagataaacatgaagatactggagaagtcaattatatatccccctaaaatgccttcagcgtgttcaaaagcaccgagctctccgccatgatgtttgtaagggggtgacgttagatagtgatcaaagaaaagtctaatacatgttattttttgttgtacagttcagttccttgtacataattcatgtgtcaattgatactcatgaaagttggtcttgaaatattgtatacagcccaaattaagagcttggcacccaatccccacttggactacaaatcacttcctcttgccaaattagagtctagagtaatttaccgtaagatgggcttttaaccctaatttctagacatactcagcagtctgctttgaaagctcatcagcttctagaagcagctcatcgttaaggagataccatcagggtaaacacatcagtttagtcttttttgcaacattgctaattccacgttgtaatcaaggagaaataaatggaaaactcttacttagtattagtttatttagacccatttatttccatcagtgaccttgggagatagttggttcagcacattttctcatattcggcctctaattcagtgtgggattttgtgtttttataattaacagagacatttacaaatagaaaaaaatatatttgtgcttttgggaaaagtgccaacaatgtggctatggaatttgattttctaaatggagactacacaaagtgtagattttttatttctaatgtatgtctctgcctatctactgatgatggattttggctttatggcaacccactaccaggcttttagctgtcagaattggacaacgtattgactcctaggtaggaaccgtggaaccactgcgttatcatgataagctggtacaagcagagaggatctattttctaagcagatgtttactaagggactactacactcgaatgacatcacatctttgttagcagttgtggttggtgccatgtttattaaaagacaggaagaccctttggttggctgttaactattgcatatttgtctgtcttgtcaataagcatttttttaaaggttacttttcctttatgtgtttacttggggttaaaattttgggattatgacaaaggccatattttgagattatgacaaaaaataattcaaaaatgaattattgaatgaggaagttgggtctcattcagtaggttaggtctcctttaaaattgtatttttctcgtatgaagacccagttcaatgggtttcatagccagtctgaggcaaaagctggctatttacttccaaaaggacttctcctcaaggaagagaccccctagtgatacccaaatcataaatcagagttcttaacttgggatctatggaacagagatcagggagtgagtcttagaaggcccgttaacctcccagtatgtggaaaaatgcttcagatgttgacacatttcacagaagtgtcatcacattaacaaagggctcataacccataaaagttaagaaccattaattttcaggtaattcttctaaataatgggtcctggccagctctacatgatttggagcatatttacatacatttgcatactgcttgtccttggtcatgccattcaactgccacacacctcattatagaaaagagaaagaacaggatttacctaaagctcaaaggaatagtgatcctgtgctaattaaaatttgttctggtatttgggagtctcagatgagaaatctggagtcatgttgagtttggttattttactcatttgtagtcagtattcaattattttaatttagcttgtgcattttcatgcaccttatttcctttttcctcctttcgactccatttggtacatttcatctcactaaacaaggagaaaaaaagggaataggagttcttgaaactcaaaagcagcattaagttcttgtctgtgacccttattgagcaaagattaggaccagtgtttacaaatttttcaagtactctcaggagctcttgatgcttagactctagaaaatgttgggtttgttcttaagaaacagaaagtgtccaaatcccacttggcttcctaacctctcagactcactctctgccctacagagccttagaaggatggccaccaacacctatgagatttactcctgaatcatttgtctcaagccatttcccactctgctatcagcctgtttctgttaacctggctggtgattccacgaatcattgtcccctttgaagatctatctaacctcctggcttgatgctcctcgagggacctctagcttctgtggattcaaatgctttaaggaaaaatactcagtctaatccacactgtctctagaaccagctagctttgtgcaatcattcaggaacatctctggccctccccacccacacactttccatcaatccagaaatgatcagattcagcccttgctcacagatgtgaagccacaaacggcagctagggtcaagaacagcaaggttactactggatgctgactcaaggcaagaagaggagtcaggcacaaaattctgaaattagtcattgagggaagtacaaagcttaaccgtagacaggaacctggaaatgctgggtcagcctcttcgtctacccgtacatgacatacaaaattattccatgttacttcaatacttttacccagagccttgtaacaatcttcttgaactgttgaatctatacaggtgtagattgggtcaggagatagctttaaaagtttgttgttcacgttcgtgccaactcctggtgtcttagattttgttcccaaacactcattatgacaaaaggatttaagtgcattctatttatttgtgaagtgatgcaggaaactacagtaaggagtgcggatgtgaataagtggaaggcaatacagtgtgtgtgaatggtaatgtcacctccatgggcgggtggggctcagttccgttgaggatctctggaagactacatataggctggctcagagctgtgccccactggggcagctcactgggttatttatctatcatctccctctcattggttggagcctgcttctaaggggcataatattcaggtgctttccacctgccaagagaggaggccaagcatgctccagtggccgcagaaagtcctcagcagaatcccagggtcttctaagaagaagacgtggagatcgtgagaatagtgagtgctcacagtatgtagcggggacaacaacagtgtctcccacaaccagcattacagataaccaggagtcgaccctgatgaagctggtggctttctcagctttacagaatgctcttttctgcttcgcctggcaaaacaggaggatatctgtctcaaagttttcaaagaaaggacattcagtgatctgttgagagattcagaggttctccttttctctggtggtgctctatcagggacagataggtccctaagacttagcagcaaaagggactctccctgcagaagcatgtgcatgatgtgagtaggtgtgcccacagcccagggttcatactctggggcttcatgcccttttcctattctttgtctccaaccgcatcttataagaagtgcatgttaggaaagagtacactaaagacaggaacagttactggattaatataactttaaaggtgagcatactggggaaaagtgaacagcaacccttaccagaatgtttaggtacatttctgcctccctcttcaagctgccaggaaagtgcactgtaagttaccaaggagcaaacttcagcgcttttccaacagtcacaaaggactctctgccaccatctgtgttgcatgtgtgctttacctttgctgtcctccttactttgaaataaatcccacccactacggtgtcccatttcagaaactctaaaatacttacttgaatccctggaatggattcatccaaccctgttcggttttcttccttccagtgtgctattctatagtagaaacagtgccaggccatgggatttagacatcagaggcatttccaggtttataaaaaggcgaagactgtattaaagtatttgcttttaagtttgttggccagttcttctcactgaccctggataggtctaggctactctcagcttacctaccatgtctttgtaagatgtgtagtccatggtgcttgaatagcaccacaaagacgtggagaggtaaaagacataagatgatctcaattttgaataattctccttgaggggcaattatatatttttggaaagttcattcttatttattgggccttctttatctcagaattcaggaaggggcagagtgttttcttcccaagttactgactttcttagcatgcgaggctcaaatgacaatgattatttagaatctctgagcagctcagactcagttttttttgtaatgccagcatataggtcaaatgtgaattccttacaattttttctgaatgggaagtttagggaacgactccaatgttcctgtagtcgctctaagtcgtttaggtgtgctataggatgaaaagaagaataatgaaactgtggtatatgcatgccgtgggatatcattcagtcatacaaaagaagaaagtcctaccatttgtgacaatatggatgaacctgcaggatattatgctaagtgaaataagacagtcacagaaggacagaaactgcaggattccacttatatgaggtatctaaaatagtcagactaatagaagcagagtagaatggtgatttgggggagcagaaaggggaaatttattgctcagtgggtataaagcatcaattatatgggaagaaaaagttctagagatgttttgtacaacttagtgcttttaggtaacaaaactgtaatgtgcacttaaaaatgtgttcagaggctgggcgccatggctgatgcctgtaatcccagcactttgggaggctgaggtgggcagatcacgaggtcaagagatcgagaccagcctgaccaacatggtaaaaccttgtctctactaaaaatataaaaattagctgggcgtggtggtgcgcgcctgtagtcccagctactcaggaggctgaggcaagagaatcgcttgaacccaggaggtggaggttgcagtgagctgagatcacgctactgcactccagcctggtgacagagtgagacttcatctcaaaaaaaaaaatgtgtttagagtttagatctcaggttaggggatcttgctacacacacacacacacacacacacacacacacacacgcacacacatacaaatacaaagaaatacaatgaagcttttagaggtgatggatatatttactaccttgattgtggtgatggtatcacaggtatatgcatatataaaacatatcaaattgtatacatttaacatgtgcagttttattgcacgttaaagatactttaataaagctattaagaaaaagaaataaaaacgtttgctttcatatcctcaggtcatcatggattcggatcctagttctcttgtgtgaacatcttcctcattttccccatatgaaaaatagtggatttaatatatgccttatcacatcagtttgtggattaggagacactgtatgtatgaaacaccacagtcaataattggtaggaatctccttacccttcttcccttggtatgtagcaacttcatgaatgaaaacactttccccaaataggtatctcacagagaagaaaacactatgaattcatgacccatttgcatagttttaggggttaaaagagctgtatataaattgtaaaacatattaagaaatttagagaaataatctaagggttatcaaagaatgttcaaattccctcagattttgtttttcaccttatctaaattcatattttcatccctattttaagcagaattattcatagttatctacttagcagatgttcaaggatgatattctctttgtatccatctttccttatccagaggcgtaaaggaaaagcatgaagataagggacacggcatcgttaagtatcccgggtttgttaacagtagaagagagtgtggacttgcttttcactttcattgtgtgtgtttctaggagatcctctatcttcatgctcagcccccaggtccatgtgtccttctctctaataggactgtgctatgatagctgttggtgggagagaggtcttgcaacctaaaaggaaggagagccatatgcagaagagagaagtgattagatgataaagctgaatggtgactctgaaaaacaaagtaactgtaaatttgtggaacttttggtctttcttctcatttgatgattagaaattttttagctgtccaaatccagtccttgtcttatctcagctatgcagagtggcatggctggttcaagctttcagtgaagaaacagatgtatgaggccaaatcttgcaaaatgccagaagagtgtatttgggcagaataccaaaatgagttcgggggcctatatggaactgcgggcagggccaatgacagatagttgaggactgcaatgagagatgcccaaatataagtatgacaagcaggaatgtcattctgtgagtcagagtcaaagtcaaaaagactttgtaaaaatctactttggagactaggtgtgggtgtctgatttagaacccttctcatagtctggtgatttctaatggtgcttttgccgaaggaattcttaggagcatccaagttccatcttaaagacatggctttgccagtctgttgtgggtgtgctataccatatcagacagagaaataaggatgtgtgtgaaggtatgaatctccggttgacgaactctagtgtgcaaataagacaactgtctgtcttttaacatggtacgcacatttctgttttgatcaccctttctaccagttggtgaaaactttagcaaagtccattcattgtctccataatcccctaggtttctatctaattttcattgagcttacaaggcacatggcaggtgggaggcactctggcatccactgagatgttagtgaacccatctggtcttcatttgtttccttccaagctcaagggtgattgagtttgccagccttctctccactgttttagtcttttcccaaagcatataaggactcttctcttgcttccttgctgaactgggcttggagatgcagctcagagagaagacatgcccttgtcccttcataataaaccatcaacatgtccctttttacatgtctgctatttgtctcctcttctttccagcccagggagtctttatctagataataggtcgagtaacctggaccacagtccattcttccctgtctaccattgaaggtacaaaacgtataccagacacctttaagatttagaatttgaaatacaagaatgtgggttcttacaaaacaaaacttggaattttaaagttaatttttgttattcttgagctctctgttttttgttttgttttgttttgtttttgtaacattatctctctcctgaggcaattaaacagaaaaggagtaatgagcagagtgaaagttaaggaaaggtcttatttaattcctgcccaaactttcagactgcctgatgggaaccccagttgaataatggtgggatttttgttgttgttgttgttgttaagcaaagatgatttccaagctctgcagggcagggagagctggagagttcacatgtttgtatttgaactcacatgaaacaatgaagagtgaaatacagtcctgtttctctagcagtgaaatttcagatccacagagaaacaaggctttcattctaccataaagaaggacaaaacataactgagaaatacagtgtaaaaggaggaatttgcaaagaataatatgctctagcatattccagcaaggagtgatcagatgtgggcatagcagtcatcattggggtgaaatccaagacaactatgggtagcaaaggaagcagctatctttgagaaagtaagactgataaggttttcagtccaaatgacaagtaacttctagtttctaagtataagcttttgcagttgggatcatgcctttttttttttttttcttaagaaaaaacttaaattgcttttactgacaacagacattgccagatttatccacacaaccagtgttccaaatgtcatataaaaatgcaatgcagcaattggccagattgttaagtaacgtgctataattgtttttatttgttttaatccctgtgaacaaacattttattttttgtccaaaagacaaaaaggagttgaaattttatcgttgtttttccaggcaaaagaaaatagggtatttgttgactgaagaaatgagatatttctctttggcagtttgggcggcctaattgataggaagaggtctggtagctgagaatagcagggttagaacaatagaggattccaagatcaaggggaagggtcagaggttcacaattcccaactggagtgggtgagtgggagagaactttacaaaagaaataagagcaaaaccatctgggtaaaaatgacaccatgtcttgatctctgggctaaggacccctggaagtgcaaccatttacactcgctcttgaaaatgcctcattgtgggttcagggataataacccttaagctaaagcctttatgagttggaagaagagaaaatgtgcttcctgtttcttacagaggatgaaagaagcagttaattcccaaatccagcctccaaacaccacaatggagcattttatatgtggaggaaaattgctaaaggttatttacaattagatccataaaaataattactggggacttttaacaaactttatttaggctcttccatacttaagacacaattctcaagaatatcttgggtaattttcaaactgttcttttccttaaaacgatcaaagggaattggttattatccaaggtcaacttattaacgagagacagaatattccccaattacagtatttctccagcgcagttcttactgagctctaggcaaggggcaaaatggggaggagagagtgtagtcagaagtcccagggtcttacttgggtctccagctaactagctcagtgagcctgggcaacacccctgacctgtctgcatatgtttccttgtttgcaaaatgaaatgagaggggataattctaaaaatcctttctttgtgctcttcctaattttttttagaactgctaaatcattgcacgcatgaaatgatttgcttttgttctctttgaaataatggagctcattgtctaggatctccagcttctatttctgtgaagcaagatctaacagcctttgatacctctctgtctactttctagggaattacagatataatttgtggagacacttagtcaaaaattgtcactgaatgccttatgcttttccacaatgctttcagagctgaatccttataggaggcaagtcagagatgaaataagaaggactgacaggaaggagaggtgtaaacagagctcgtgaacacacatgaaaaggcaagtgataggtacacaaggacatcaccaagaagaaggctctttttctgcccttgcagtataaaaatagttatttattttttcataagatgatgttggaaaagtttcaaaggaaaggcttctagtgtttgatgagcacctgctgtgtaacgggcacaggttaggcaattttatacaagataaagatgtttgtacccacttaatggataagaaaattgaggcacaaaggggttaagcagtcttcccaaacttacccagttattcattttaactgctgtgtcatgttcctggtgtgagtctgccaaaaattaattcatttaacctttttactattgtttttcatgattacaagcgtttctgtagtgagcatccttatacctgccctcatgtttacacataagagtatattttttaggtaggtgcaataaactaagcatgtatctgtagatatgtgtatatgtatgggtatatatacacgttatatatatgattgtgaacatgcatatacatatgtatgaatacatatgtgtttgtatatcagtgtatgtatctacatatatgtatttttctaagatcctgccaaattatcattgcaaagtggctctgtaaaatttcactcctccccaacattgaatgaaaatatctgtttcctcatactgtcaccagtgtttcgtgtcaccatattttaaacatttgccaagctattattacattattttttcatgttcatttcttcaatcacaagtgagtttgaccacctctcaagttatttacgtccaaaaaaaaaaaatcactgtaaatgaaaaatgagtagtttagccttgccctgtgctgtgcagaaagccggtgagtttcttcctgaagaggatgctgcagggtcatttgacttggagaggagggagtggtaagatcacattatcattaagaattcgctcagggcatgtaaagatggctgagcagcttctttaagcgtgtaagtgatgacgctcaaatctatcagaatactaaccctgaaatcaggtctgagtttacagccattatatctttctttggatttggttttatgtttttacccttgatttatgtacgtacttcccttagcatcccatatctcaagcaacataaaggtattaaagtgatgggatttagcaaatatgttatggttaccatctttgttcccaagagggaatttggaaatctgacaagtattatacctttcattttcaagacccgttttctgagccgtttcgctaacaagtcccctgatttaccatgccattaacaaaaataattctttctggacagcagtaaaagaagtggattagaacaatttacagccttctcaagatacatataaggtgcctgttaagaaaaaaaaagggacagatttttgattaactgatacgtagacttgcttttaaaacatgtcagttcattctctgtatgcccatctattaagggcaatgtccctcatggaggaagcctgccatcgcccggtgccttagcacgctctcatgtttgccaacagtgattaggaattacttagttgctgacaaccctccatcattgatcgaagtaagaaaccttttctgcttcaaggtaaggacatggtgcctactttctaaatgagatgttatccagagacaacattttgaatctgtaggcaaaaacgtatccagttcaacaaaagaataacctgcaataagcagagatagaatgggtgaggacctaggacagcggctcattaggcagaacccgtcctttctctttgctaaagttagggaggaaacaaatgcctgccgaacagaaggaggagatgagaggatctgtcagccagggagaggtacagctaccagaaaagcactggacagtttcctctaatccttgggaactttaatcgtctcctcaataattctcattttgagaggatctcaaagtggagggatccattagtaagttccactttggcctggaatgagagatgccgaaaatgacaagggtgcttttctgtggtggtgtaagtagcgtggccgtggatgtgggcaattggcttactccagtctgtggcattagttagcatctctgaaaccctgagacatgattctcagcccccatggctggtcaagggattaccagagaagattttcaagtacatgggattggggggtgctcccaacccttcagtcagctgtgggttttgcgtgtgaagagcataagaggggagagagaggaaatgagagaagctggaccatgcagagccttgtaggtgatgggaaggattttgctttcatcctaagaagagtgagaagccattaataggattcggggtgattgtgagtcagggggaaatggggggaggtatcaggacatggaggtctttgcaattattagttggagaacagcaatggttcttagctgcttcgtgtgccctggacccttctctcagtctgctgaagcctgggcagtccatctcagatcctgttcaggtgcatagattaaaatattttaaattacgatataagctacttatgctataccatatttatactatatcattgtggtaataaagaatttgtcatagattaatagacaggcataggtgtcctggaactggttctgtcttaccagcttgtcaaagctgattacgcgaatttctttccaaattcttactcagtgatgccaaattggtagcttgaaatcaagccacggtgagagaatttatatcatagaatatggaaaacattacagatcaggacttttcttctcaaaagtcagctgttaaacattgaccatcatagcactgtgtatatacttatgtatttaataataggctttggtggcaggtttagtaactattgcaattttgaagtagtgatgagtatgaatcccatttcaggatatttcccacaattgaaatgtgatataataacttttttcctataactggtgacaaacacaggttctgctaatactattgtgatttgttatctacattcatagttgaagaacctgcttaattttcgttagagggtaatgaaaataagggtgcatttttccattgaaagagcctctgaactacagtgtccagaaaatgagaaaaaagagggaccatagagaccaactagaaggtgatagcagtattccaaatgagttgccatggtgtcttgtattccagtgaggagatggaaaggtgtatatggaattggaaatggttagtagataaactctatgacaattgggtatgtatagacattggggtgaaggaagtgtcaggagtgacttatagggttatggcttacaccactcaacttaataaggatgagaatgccagaagggcccaggtttagggaagatgaccatgagtttggttagggcctgttgagtttgaagtgccttttgagtatcatggaaatattaaaaagatattgggacacatgcatttggaatagagacatgagtaggttctaccttcagccttggggtgggaccaggttacgaagggatgttattctttgatggatgagcagactacaaaaagctgtgccaccctttgtctctatgtattcacactgcttcccctagcacctcttctttatctcctaacaatcattgtgccaacagactgcctttagaaactggcagatggcccctcttcgaaggatcctgtgcatacagagtaactactttcccagtagctgcatggctatcttgctggatctgcaggtccagaggaggggctgggacagtagaggagcactaggaagtcattaggatatttgcaataattgaagcttgcatcctatttgaaacttccccaaagaaaaaaatgagcgagaagagtggtcagcaggaagccttgaggagttccaaaatcagtggccagcagaggtggaggagcctaaaaatgagactttggagggagcagccacaaagataggagaaaagccaggtgaggtggtggaggtgcagggaagacaagcagagagggtgcttcagtgagaagagaggagaggagtgaaactcaaagtcgcaagagaacactggaagttcttccctgcatctagtgacacggagggtgttaattttacacaggctgtgttggtggaggaaaccagatgggaggggaagaaatggagataacagttatagacacatcttttaagaagtttggcggctaaaaaggagacagatagtgaagtagttggaggtggatgtagagaaaacaaagttttttttttctttcttttttatttcctttccttctcttccttcctttttccttccttccttcctcccttccttcctcccttctttcctcccttctttcctgtaggagatactttctcataaggattcatttgagacagagagggtaggagagaagggatttatgatggcataaagcttctgagaaggtgggaaaggctagacttcaaaacataagagggacctgttaactttttaaacctgggagttgaatcaatgaaaaactgagtcaatgatgtaacacttttaaaggtagttgtttattgccccccatcttagagaagagccttttctggttacagaagacaaagtgatttaatgtgtgctgaagtaagctggaaattcaggtgttcagttgatgtttttggagtagactgtgaaattgaaattggagagacattatccaggcaggaaaactatgagttaagggctctggacaataaaaaaaataagggtgtcatccttggggaaggagatgggagatgctgatgcgtttagggcttcagagctgcacctgtgctcctcttgggatcagaactgcagtatctctgcagctgctgcaccttgtttttaacccctgcatccaagagctgagtgttgcatgactctcaagatgcagatattaaaaccttattgactgatgtagactcttctgtgcatcaaagggctcagaagtggtattagctggctgtctccttttaagtgcagagagtgcttttctgtagatagtgctatgagctacctggggttaagataaaaggcttcaaaaaggtagtgtcttcccggaggctgcttgtggccactcgctgtgtgtctgtggctatacagaccccagattgctggggctggactttgcatgtctctctctattaccttctagagcctgtgaggcccaggcttttaaagattcggcactgaaagaaactaaaaccaaacttttgagtttacaactgcctgaggctgcctccatctacaggacctttactaactgtgccattttggcgaaaagatagattttgaagttcaatcagtcttggtttcaagtattagctattcctcagatgattgtgggaccttgaacaagtctcttgccctctctgagtcagttttatcatccatgcaatagggataatattacctacctcataaaaccattgtcgagacccatctattcagcacatacttgagttcctattcaaataccggctgctgtgcttggctgtggagtctaactgcacaaaatggtcttgaccctgagggttttatagtttgagagtggatataccaaagtgcctggctgtgattattatattgtgatataataataaatacatatttggtctctgcccccagttctaatatttagtctgtgaacccagttcctggcagacagcatctaagagctttgtaatttcctgagtgacgggaacatctgacacagagctccgaaatcccttggtatttcctggctgataggagcatcttttgctctaatgagttgacttgtgctgggctcctggatacccccaggatgggtgctggtttccaggggaatcaaccatgtatttttagaaggttggggctttcatcatccaccccacctccagggaggaaagggaggctgaagactgagttgatcaccaacggtcagtgagatactcaatcgtgcctatgtaacaaagcctccatgataaccccaaaggacaggggttaaagggcttccaggttgctgaacccatggaggtttctggagggtggtgtgcccacagagggcatggaagctctgcatacctttccacatacctttccctatgcatctcttggtgtgactgttcatctatactctttgtaatattctttataataaatgcgtaaatataagtaaagtgttttcctgagcacttctgtgagtcactgtagcaaattaatagaagtcaaagagggggttgtgggaactccaatttatagtgggtcagtcagaagcacaggccacaacctgggccttgtgactggcatctgaagtaggggacagtcttggaggacctgtgggatgtggctttatctccaggtagatattactgaattgaattgaatcagaggattacccgctggtgtccactgaagaatggcttgatgtattggggaaaaacccactcatacttggtgtcaaaactgttgagtggtgtgtgacagtaggtaaaacattttgtttttttttctatccttcatattggcccagagagcttatttaataaatatctcattcatttcttttttcttatccattataccgtaggctcagctgaaaacatcgttcatgacccacctgaatgcacagtagggtacttagaaagtactgcatggttagcagacagctctgtagggagtcggaacagccacgcagtagagtcttggaagcagaagagagtaaggcacagagaccccgaatgagggccgagtgtggacatccacatcacagctccacccatgactagtcacaggaacagagacagtcgacttgcctctcactctctgcctcagtttcctcacctgcatgatggagacgataatggtacacaattctaaggtggttgtgaggattacacgagctggtggtgttgcgattctgaggtggttgtgaggattacacgagctggtagtgtgtgtcaggtgctcagaacaatgcgtggaacatggaaaacactccctacatgggagatattatttccatgttcagaaacaagctggtttcattaaagcccactgctctcaaaaggcaattcccatgggaatagtgatgacttgaaattctgtatcaaaatgctggtggatgctgcttcgtttgtagtttcttttcttttccagtctccacagggctctgttatttggatcctctaccatgaagaacagtgcccctaatcgtagactatcactttgttggccactgtgtgttgtccacccattatactgtgaggtctcaacagctttaatttcaataatttgaggtttgttcaatgcattatattccagatagttcacggatgcttttaatttaattataggcactttaacaccacagatgactgttggggaaacggaaaatgtcattctttctgaatgcaagacacgtgtttaggactgataaaatacataactgtgttttatttcagaataaaaagaaatgtattaccaagtatgtgacagtaggtagactgctgggaagcctgggtctgatacattgttgtcagaaacaggctcaattttggtgaagcgaagggtgtacggaggatgagccttgcaaacaagctaaggtgcccaaaggacagctcccccagtgacctcagggtcagcctctctcttacgtacatacaaggagcccctcctggaagcaaaccccactgcagccttccaacaggcacatccttgttcttcccactatcttattatttgtagcagcaattattcattgccatctgaattcactcagtaaatatttattgagtaccctgtatgtgtaggtagtggtgatacagcagtggacacacagacaaaaatccctactctgaaggagcttatattccggggggaaaaagagaggaaaataagtaaaatgtgtgctggttttgtgcatgaagatggcaaaggctatggagaaatcaaggaggatagagttggggaggaacagttgtaacttccatagtgtgggtggagaaggcctcactgaggcatcaacatttgagctaagtcttgaaagaggcaaaggaatgaaagaggtgccaggccaaggtaatagttcctataaaaatcctgagaatggagagtgcctggtgtgtctgaggaagcccaaggaggtcatcatggagtgagggggagataatagaagatgaacttcaaaaacgaagatgtgaaaaattgcattgatccttgtagtccatttggaagggtttagatgttttatcatcaccgtcgtcaccatcatcactaccacctgctagaaacttcggggggcggggggtgggggggaatgactcatcatctcatctctgcactcctgaagctccaactcagcacaggatacaacgaaaggataatgtgatgcttggtaccaagactttaaggacattcaggagcggacagaaaacatgacctaaaagagagggaaaaacagagactttttacagggtctcccttaggaaagggagctatcccttaggaggagatatctaagccactatgcagttgtgaggtctttagaaatcaaccaagtgcattggtcagattgaggctaagttttccaacacagagaaccctgaagtcccattctgtactttgtcttgactctcctttcatttctctttatcactcttcgccccccactgcaggtacctgttcctttttctgaccatgtctctggacttggagaaggttttctctcataagcttctatccagccctacacccagtggccatacaggtccacccctctgtatggctctgtgcattaatgagcagctcttcttagctcagcgtgctcactgtctttaggaatggtttctgctgaatccattgactgcacaataagcccagtggaatgtgtactctaggccccagttacctccaaggagaagggatgataaatataacagtgacaaaatactctcatacacacagaaatatatagttacacttaaatgcacacacatatatacatacaaatatagagtgggtgcagtggctcacacctgtaactccagcactttgggaggccgaggtgggtggatcacctgaggtcaggagttcaagaccagcctggccaaaatgatgaaaccctgtctttgctaaaaatacaaaaaaacagccaggtgtggtggtgcacacctgtagtcccagctactcaggaggctgaggtgggagaatcacttgaactcaggaggcagaggttgctgtaagccacagtcacaccactgcacttcagcctgggccacagagtgagactccatctcaaaaaatcaaatgaaaaaccacatatagttatatataaaagcatgcacgcatgcatgaatatacctatacatatacatctatgtttacatacaaatgcatgcatacatgcacatatgcacacacctataattataaatgcatgtatatatatatatgtatgtatacacacatacatttttatagaaatgcataggtatacacatgtatagagttgtagatgtatgcacatatttgcatgcatacatacatgactatacgcacaatgcacacatgtttatatatgaatgtattcactcatacatgtatggttgtgtgtgtgtgtgtgtgtgtgtgttttgggaagactaattactccaggagatttacatgtagtttcccttcttaagtagatcacaaccctgctctgcatttgctgccattgtttctgttacgtagatgaggaatttgagtctctaaaacttgaagttgcccggccaaggtcacgtagctagtaagttgtgaagctgatattcaaactaaggactaaaagataaaaaagaccactttcttccaatgcttaaaagatgttaacagaaagagagcaaagcaacaacaagaaagaaggaaccctaagtatgttcatcgagctactcacagaaaacagaaaatatgattacaacataaagtgataatttccataaaagaaaaagttacatgagcacatacaagagggaataacatttgaggaatctcttgaaggatgggtaggagttttttagaaaggggtggggaagcaaaaagattttgcttttcatttaaagttatgatagccaacatttaccttttagaggtgctcaaaaggcccactgtacctttggcttcatagctgtagaaatcgggcattttccaaaaaaaaggcagtgacggtgcctcacatctggccacaggcatctctcggcagcatgcaggtcatctagggcaagtctctgtaaaggcctttctctctggtgttgcatttgcgtattcatatgtctgcatacaaacaccaagtctgctgttagtggtgtcataactttgcaaaaggaagaaaacatggctaacggtaaaatgagttatgcctttataaaacattttcaatgacagaacttgctcccctctgagtgctttttgaggatcagtaatcataaactgtggctttgccaggaggtgctgtcgaagattgtgtggacattctttcagcaaaatcatctggcatgtgtgattgcttctatttattcaatactaaagaacagaagattgagttttatgagagagagaaaaatgcacattccacatagagattggataaatttcattgtttagagtgtttttattgccacaaagtaatcttctgattgctaggtgagtaatcctgtagttacaaaaacaatcaattaattgatctaaattaatcggataacatattttagcctgctaagcatgaaggcatatttcaagtaactttccagataaaggaggtattgaaccttttcagccaccagccagggacagtgacacagattctagtatcaaatgctgattctcaaattaacaaatgctggaattactatgagaaaggcatggactagggagtcatgaagtcctcccccttttgttatacaggaagcttctaagctgcctgtcccactgttcctccagctcttttgtcccaggcttggccctactgggaaggagacttccctaacttctgggctacccctccctttccctacctctagccacactgtgtttcagggagggcaacatgggagacagaggaaattaagacacctgcatgaaagttgacagagttacccaagaggagatgccactgggcagggactggagagcactcaagggaagggaggcaagtccgtcctttctcctcctttcttcttcaaaatgtattgaatgcctatgcttttccaggcagtttttaggcacttggaatacatcaatgaataaatacggcaaagatccctatgcttgtagaactgacattctagcagaagagacaactaatatataaataagtcacatagtattttagaaggtgatatatgcaatgggaatagaaaaagcagagccgaatgagggctagatggatgctgggatcctaggtggagcaactggctactgttaaaatttatctgagaagtggttccgagagacagcggcagcagtagaggagaacacagcagtcagacgagccaggagggttcctggctgttccctgcacatgtcattaatgtgaacactcaccagcatctcttagctccttcatctttaaaacagggataaggatatctgcaatgtggggaagtgggaatgattaaatatcattgatttgtttttactgctcctctttaaaatgacagcatcaccacaaaggagatgaaatagtcaatagtgaatggaaagcaccaagcacagagactggcacacaatgggtactgagtacacgtttacgttggtactcataaaagaccaggaagagcttatatgtggtgccctggtaatgcctcagatactgttctaaatgcttcatggatattagcacatttaatccttacaaccctttggggtaggaactaatttatgtccattttacaggtaatgaaactgaggcacagagaatttaagtaacctccccacagttttataattggttagtggtggaggcaggatttgaacacaggcatcctgcttctggaactgcactgcagttatttttagagcccaggctatggaaagaaaccattcatttattcacggaacacatttttattgattatctgctacatgacaggtctgtgatcagcactaaggctatagaaatgaaagacatagacagggttcctcccccaaaacattcttgatgtaaatgtgagactcacactataaccaccctaaggattttggtctgaaaagacattctttattaaggattatacatttatgtcctggatttcctagatctggccctgaaggtaaatattccattttcttattggagtataacaaccaacgtttgactgcaaaaaatgtggtagattattttcattcatatgaatatgcctgcccttttctctggtggagtctggcccggtaagtctgtgggacctgcctctaccaatgaggggtagagcttggtgacttttaacaatgatctcctcattagatgaggccatcagttacagcggaaatgatcattattggaaagctggagaccagctgctgtcagagagggatgggctcctgtggaagcttgcaaactgatgactacttaatccttgaacttcagcagcaacaacattagctgaaggtctgtaatgcattcacagttctcatctgacattttccccacatcattatttttctggttttacttttaaattccctataggaccattgacatgaaattctgagggggaatttggaacattaatgactgtttaaggcaaatgagtaagtgttctttccaagaggaaattgtctttataatattggcataaggctatttttaaaatttatactaatgagacgattcgaggcagataactgaatttcccaggcttgaagttggcctatgccccttggtgaattcagccttagggtgagctctgtggggccttgcaagtctggctctagatgcaagagatctgccctatccacattccttctttccataattggttagagccttgaccattcaaacctgggcttggatgttgggcttacaagtggcacagacagtcatggagcttgctgactacaagggaagaaagactttatcaaataacactacttatggatgtctcaactacaaacatgaatcaatgacttgaaagaaggagagtaatattccctgaccttaaacaataaaggactatgaccctgtttggggactggggatggtcattgagggctcccctaaaaataaatacttgctctgaacctcaaatgaagtgtaggatttagaaaggcaaggggccaggtgaaagaaaatggtttcaggaggagggaagaacaagggcttgaaggaatgtatggtccccttggaccatctatgcttcctaatcctggggattgcacctccagtgatataagaatgtgtggcaaagggaaccaggttcctcactgactttgttcccatccatagaaccaaaagggtcttccttagtaatgcctatggctattgggtattgagttcttactacaggatagaccctgctccaaggactttgtgtgaattaacttatttgacctcgacagacatttgcctcaccccactgaaacaagtgacattaacagcaatcaaaagattacccggggacacaaggctatgtaatacagcaatatatgcaatataaaaaaataaataaaacttgaatgcttccaaatgtctatcaaaagaacacaggttgaataaacaatggaatgtctacacaaatgagtactgtggagctctaaaagggaatgaggaatagggctataggctatttgggataatgttcggatatatttttaaggtagaaaaagtaagatggagaaaattgtgtgttatattactgcctgtctttgaggggatgcacattcacatacaaatttacttttttaaaaaataaaagttaggttaaatcatttttttaaaaaaatagttactgttccagttatcttttttctttgtataaacagggtctcattctgtcactcaggctggagtgcagtggtgcgatcaaagctcactgtagccttcaccttctgctcaagagatcctcctgccttagccttctgaatagctgagactacaggtgtgcaccgccacacctggctaatttttaatttttctgtagaaattgggtctccctgtgttacccaggttagtcttgaacttctgggctcaagccatcctcccaccttggcctcccaaagtgctgagattataggcataagccaccatgcccagtctatctacttattttgaagcaaattagtgccttaaaatgtcaacaccattttattatcgtctctcacagtgtagggattgtctgggctccgctaggtggatctcagggtttctgatgggcttgcagtcagtggccgaggctggagtcatctggaagtgcgctcgctcatagacctgggtgtggaacagagagacaaacctctgagggttgaggctggaactgctaaggctgccttgacatctctctatggtctctgcagcaccaaggcttacaggtagctgtatgttttacaagttggcctgaggctccaaagatgcctattccaagagagaggctggacaagctgtactaccttttatgacttagtgtcagaaggcacacagtgtcacctttgccacatttctttttttcttggcagataataaggcccacccaggttcaagaaaagtggggcagcaggggaaggggatggactttacctcctagtgagaagatgataaggtctggaagaggaggtatggcaaaaaatattgctgtggccgttactagaatatataatctgacgcagttacctaaagtgaaaagcgtgaaataaaggctgaagagatagggaaaaaaagtacatttaaaaaaaaagttgtttcatgaatttgaaaacaaaatgaaataaaaagcctattctaaaattcaaaagtcagagaaacaattgaacctaagtgtgtactcaagatgctggcataaccacttgataggaactacccctagttattttaaaacgcagttatttgactctgtccattaaagacaattgaaaaccaaaaaccaaaacaactgcaaagggaaatcttaaagtattttcaataatactgcttttggaggtagtgttggtatatttattgttatataaaatatagtataatattgtgtgtattgaaagataaatgtatatgttaatttggagaactagaatattgaagtatgggaggaagaagatgcagatataagaccagcgagattaatttaaaatgctagagaattggaagtgggattatacatatgaatttattaggtgttttatcttagaaattcatgtattctctttctactaaaaagccctagaaacagtgaccaacccaatagcaataaacttccttagcaaatagattatggtcactagtgatcattttctagcaaaagaaaccaagctgtcttgagaaaatgattgagtttatatttgaggcaggaaataaacaagaagaatctgtaaaatcttgtcataccaagaagcagagaggctatgagatgtcattagggtcatgtcatttaaagaagccagtatgagtagctcaaagatgagataatttgagcctcaaaacaaaataagtgatttcaatggatttaaatacactaaatctgtttaaatacataagttcataatgataggggaaaacaaaattatttataggttaccttacaaagatgatagaaaccatctcattattttagaaacggaaaggaaaaaaaaacataaacaactatcctgcctttgttttcagaattccttgtagaaataattaactagtggatgaagagagtttctctttctaggtaataagcaacgaaaaaatggcagaattagaatataatgaatttgcagttcttactaaattaatatatctaggcagtaaccatcaataaaaagaaagaccatatgacatttgtatgtcctgaagtaagttcacaacgccatctagtcttgagccaaaaatactgcacctgaatctgatccagcctccaggatgtatctatttataggaaacacagtggacaggcgaacatgttaaatgacaccacagagatgcaatctgcgaacttccactgtggaaacaatccaaatgattcaacacgatgttgcaaagacaaaagaattatacatgaacaggaggctggatgaattaaaaaacataagagatgtatcaatcataatctttggttctaatttggattctgatttaaaaatagactgcaaaaaaatttgttagaataatatgaacaaagactagatgtttgctgccatttagaaattctcattagtatttgttcagttatgataatgcatgctgcttctgttaaaaaaatacttttaatcttttacagataccttctaaatatttatagatgaaatcatatgatatctagaattttctttaagacaatctgtggaaggggtgagtggatgtgtgctcaggtgagctaatggtagccatgagtttaatattgaggttgagcgatggatacagagaagttcatcatacgaatctctccactttgatgttttcttgaactctccaatactaaaaatttagccaaaaaaattaacaggggcaacgaactttcttctttttccaagggctttttatcgatgattttaagaaaatggtcagacagcgcaggcgtgttttaccttagtccttccaaagcagtaaggtgcacccacttctcagccaccctccctgactttgttttcacaacccgaattcaccaggaaaataccaggagtctgctttgtattgtgccatcttttaaataatgcctcactttctagtagcaaagtacctcattctttttcttgatacttcaaaaaaacaaaatgaaacaagaacttctcattagctgaaagtgtttttatctagtgagaactgaaatcttcttggcttatttcctcttagatctaaacaatattaacttttttttttttttttttcccaaacagagtctccctctgttgccccggctggagtgactgcagtggcacgatcttggctcactgcaacctccacctcctgggttcagggaattctcctgcctcagcctcccaaatagctgggattacaagcatgcaccaccatgcccggctaattttttgtgttattagtagagatggggtttcaccatgttggccaggatggtctcaatttcctgagctcaggtgatccacctgcctcagcctcccacagtgcgaggattacaggcgcaagccactgtgcccagccttaacaatttttttttgtttgtttttgaggcaaactctgactctgacaccaggctggagtgcagtggtgcgatcttggctcactgcaacctctgcctcctgggttcaagtgattcccctgcctcaccctcccaagtagctgggactacacacgcaccccaccacaccgagctaattttttgtatttttttagtagagtcggggtttcaccatgttggccaggatggtcttgatctcctgacctcatgatctgcccacctcagcctcccaaagtgctggaattacaggcttgagccaccgcgtctggcccaacaaatatttttaagatgcattgtctactaacaggagatgcctctgattctgaagtactttgcgataaacagccacacaatagccaaatgaaatcttgaaatcagagggttgctttctcatgaagttagactgcttgagaattgcagtggcttctatatggcaggtgcttaaattgtccaagttgaaattctaatttttataatgagtagggatgagtgcatgaaatggttgtgtgtttttttatttcctacatacaatatcgaattcaatcccaaacttgaagcattgatgtaattgaaacatgttggtaattttaaatcgtgcagttctgtacatgatcagaatcctaatcattattaaaataggtgtttctattatatgcatatgtataaaaagtcctccaaaatgttaaattacctttctcatctcaggaatagagtcccaatcacttccagattgaagcacttacggggggaaaaggcgaagggctccagtaattttaaattgcttcgtacaatgaagagtgcctgtaaattactgaatgtggtaatttgttccataagcttttttgatttgtaagtaacttagtggatttgctggtgaaacagtttggcaggttcctcagataatttagagatattgagcatagacatctaaatgtgattaaaatgtggtattagcagacattgaccacaggaagggtgaggcaggttttcaagttacagcagctagagaagctgagaaagactacagtcgactctcaggggacttgggaaaggtactaagaatgcacaattgagctaattacaggaaaatgccacacggctggctttggaagaattcatccagcccctggcatgttttgcttatcctctgcctgatgataaaataggggttatttctatcagtggacacatttggcccatatcttaattcaggcaacacagccttagccttgttctgctagtgctaattatttttttgaaaaataatactgttaatatagtaaaatgtagttgttggactcttagaaatggataaagtttaggtttgtaatttcccagacagagagagagtggcataagcatcgtgtgaattcccttctaataggatgtcttcatctttactattttgcataataatgtattgtttggccataagagggatttaggtactggatctagaggcattgggtgtctttaaggtatgaaggggtcaagcaaatgtctgccactcacagagtgagggaggtggagccagaggttctgaacaaagaacctcaccaaatgatggggagaggctgtgatgcatttcatgaggcagtgatgatgtgagtcttgggctctgtaagtgagggtgcatagaagagtaggtcccgccctttttaggagtatactgtggactagagtcaatctgtagacaaagctaggctaacttcctactgggcaacgtctgacccctttcatctttgacctcaagaaagtcactattgttggtaaagtgaggaaggacatggaacctctggggagaatctgacctaaaatggcttcataaagattctcagcatgaatgcccttttttacttgatgaaaatagacctgatagtggttgggttatttgagcagaacaataatggtaaagggaaaatagtagtgagatttatggtgtaggatggtcagatgtggtatgagtatgacacggagccagaagtgcctggtcattcactgatttgtcacactaatggagttagaatactctaccttgcaaggcagagtaggagtagagtatccagtcatcctggtttgcccaattctgtcccacttttgacacagagagtctcacactccgggaaacctctcagttctagacaaacagagacagttggtcatcctattatgagaggttagagaggaagcactttctggatgggttgagtctgataggctctgttgtatttgattagacagctttctatgagatcaaggttttcaataccatcacagaaccatttctggagctgtgttgaggaagagagggcaagggttagagaaaagcttgggccgcagcattgcctctgccatgaagactctttacgtctgtttcacacacagtcagcccttcgtatccacaggctccacatctgcggattcaatgaactatggatcaaaagtatcctctggccgagtgtggtggctcacgcctgtaatcccaagactttgggaggccaaggcaaacagatgacttgaggccaggagttcaatactagcctggccaacatagtgaaaccccaattcactaaaaatagaaacctcagctaggagtgttggcgggcacctgtaatcccacctaatcccagctactcaggtggctgaggcatgagaattgcttgatcccgggaggcagaggttgcagtgagatcacaccactgcactccagcctgggcaacagaatgagggcctgtctaaaataaaaataaaaatagatgtgtttgtgtgtgtgtgtgtgtgtatatatatatatgtatacacaaacatatatatatacatatatacacacacacattcaaagaaaaaataatacaaataaaaatacagtacaactattttcatagcatttacattctattaggtattatataagtaatctagaaataatttaaagtatacaggaggatatgtatagattatatgcgaatactatgccattttacatagggtattttggtatttgagaaaaatcctggaatcagtccctcacagataccaagggacaattgtgctaaccttttagataaagtttcatagaccagagacttccacagtgaacacaagattagataccttaggctagagcgatgggttttagaaaaaaggtggacacatggaattcatggatatgaaacaatacattgtccagaagtaagggtggtccatggagactggttggagtggggtgggagaaccttttcttcatcagagtcaagtcattctgggttggcaatatatatacatgagtggactggagagactgaggaggcacaagtcgaggaggaacacatcttttattttgacttaattttctttttatcccctctccttctaccccagggttcttctccgtgtggatcacattaagggagcgtataacctttcataccgcctgactaggatgatggatgtggaaatacacagtttgggagccctgtctgcttgcctgttaagccattgactgttatatactcttgggcttgaaacaccttccaggctggaggggccagtattgcatttacttttatcccatttctgttttcacggctacccaagaggaaataatttgatttggggctgcagggggtagggtggaaaagtgcagtcggaagacagagaaaatcagcaagaagattactgaaagggaaagagggggaaaccaaccagctatatatttcctgcaacatgagttaatgaaattccgttccttcttacacagctgtattcggtttgttttacattgtttggtatgtgaaaggatttggctttgcgttacagaactaattgcttactagatattacatggatatcaaaatactttataaatattaattaatcttcacctaattccctggcaagcacaaataaccagtggcatatttattgaatgtgtaagcaataatctgattcttaaagatttgttttctctgctgaagctttctcatcatttccatttgtcaaaatgcctcatctcctttgaggaccatatcagatggtacttccataacaattgttaggaaaatagtaataaagacgatgtttagagtaaccaacattattatttgctgaactttcttcctttgccaagctcttgagtaaacatttcatagatatatctcatttaatcctacagcagtcctacaataaaaatgttattgttactacttttttttcccccagatgagggagcaaagtttttgaaagctgaatggtggcagggctgggatccatagcccattctgtccacgtgtgaaacttataataaaagccactatcttgccccttttctgattcacactacagggaggacacttggtacttatcaataactccattcatttatctattcaaaaatatgtgtttgaatgcaagtactattagaggtactgtgctaggctctgttatgacatacctggtgttgactcttgagtagggattacagagttgagcatcttttctctcctgagattcatcatggtccccatgggcagtgaacagtgttgttgtcacactatgaaatgggtatagtgcctggcacaatgaccatttcttgaacaaatggggagtgatacagtgaaagtaaaaagaggatctacagtgtcgtttgcttgtgaatggtgaggggtgggagcgcttagaagatgtaaggatgtgctctcttctttcctcacactcatcttatttgtaatgacattaatttgtgttcttacctgctcagtgtcttctcagtttgacatgccatgatggcatggactatgtctgtttcttctagcgcttcatagctgtattgacacatgtttgttgaatagaccaataccttgttttatgcataaaagaaggccagtaaaaatagtcttacatgcatattaccatgaccgtgaaaataatcccaccctgggcatagcctggctcttgtttgaaatgtgtggtacttctatgtgacaagatatagaataagtcattggaagaaaaactgtcctattactatattttatataaaagtgtatcttgtgttataatgggcctggtatacagagggtgcttagcaaatcttccgcagagctgaaactgagctgaagctacggcccccttctctgcttgctctcctttattctctagagtgctgcttcccaatgcgtggtccatggaccaagcagcttcagcatcacctgagcacttgtcagaaatgcagcacctaggcgccgcaccagacctgttgaataggaatctacattttcacaagattccagatgatttgcatacacagtggcatttgagaagcattaatccaggggcttctttgcagtcagtgatggtgatttgccaatcattagcatttcagaaaccccaggccgaaaccatacatttatccttagctaggtcggtatcaagtttctctgctttcatccagaatcctaacaattcagcttggttgattatctaagaagcttctatttgataattatatatctttcattttttttaaagtgctgggggttgggagatcctgggaaatggcataactattgcttaataaatgcagtttgcttggaagaccaaaatctttcaagtaatgagaagcagcaaaggaaacaactccaacaatgacacaaagatttcctgacaataaaggggctgaggtgaggaccccagctgtggaccacactacccgaagagaaccaacaaccaaatcaatatccaaaaaataacaataacgtccaggtcatttcacttatgagacagaagaggtaaaacaaattctcagatacaaatatttctgctgctccacattgttccatggggccaggattgtgaagtcaatcttcctaatgattaatggaatttctcaccttttgttcaaatgacttggcccctttggtttttaaatgacatctaagggcaaaacagacccaagactttgtggaatgactttccaggaaacaaccatatctaggtaaacccatgctcacaggttccctctgttaatggtgaaattacatcaaggatgaccttttgaaagaataaaactcattatcacatggaatatgatagctgtaaaagagcaacgcttggaagccaaagcaaagtcccgcatatgataaattaattagaatagaagttacataaaacctcgaccttctgtgtgacccttatcttataattacctcttctttaaaagcagaatgaaatattttatgtatgaagatgttactgttgaccctaaatgcattaagagtcaaggagacatttttcacgtattgaaaataagatttgattgagtgcttgcaagtggcctagtgaaatctcattaaaccactgtttaatactttataaatggcagaatattaaccattaattatgaacatgaaaccagtttgaaaataagttttgcaatatctaagcttgattttcaacccttattaatgcattgtctttttcatagttttcagtgttttacagcaagtaggtacttacgacttaggtgtgacttttcatctcttcttcctcctcctccttctctccttcctccttctcatcctccttattgtgttgctctaccaacatggttgtaaaaatctggatgaaaataagaaaatacagtctattaaacatagttataggctgtcactatccacagttataattagatttataaatcatgtgcaagattcccagcaaaaaaaaaaaaatgaatcttaaacattcttttcaactattatcaccccaaaatgaaacaaaacaaaatatagcaacgatatgaaattgtttcagtaacattgccatgttacagtaagcttttgcatctggatcagtcagcctggtacaaataactgtatattctgaaatgtaaatagataaaaagataatgaccttcttgagcatctactgggtgacaatcgttgaaatagtatctgaatttaactgcaccaaggaacataggcagattttgattcagatgacagcttccattatttggcagcagatgcttaagaggctgctttgggaggattctgatgttggatccagcctacatcatagaactgcagccatggattagcaatatgtgttatgtgagtgagctgcaaaaatatgccacaaaattcccatcttacagttatacctttttaccctgaaatgagtcagtgtgttatggtaacattcccagatggcagacagaaggagagccaatgtgagagaccagtgaactcagacccgtctcccaagagccttgtgtaagtcatctaaaaaacaaatgtttcggatattcagggttttctgatttcaaatgtgttcataccatgaataattgtgtagcactatcttactgtgtgctgaggacattaatgtgcttcttctttcatccttcgaatgatcctgcaaaataattctcactgacattttcgtggaggtatccaacttcagctcttatggaaaagaaagtgcctctgtggaagttgcatagatagtaaattgtggcgtggggactcaaagccaggtttgcttgacttcacagtctaaattcaacccaggaacccaacagcctgttgctgtgtgattctgatccccatgaattcactatgttgtcaaatgctgagtttgcaaagcatggtctgagtgcttcccttctggacctcccttaaccattccagggctttccattgcttgtgcagttaatgaagatggaaaatgattcccttccctcccgctctgttcttccatctgtccaggtaatagcctaatgtcaacctagtgacttcatggcatctgttttcaatctactgcctccttgtctggaattctcaggggacacttaagccagaactggggttgaaggaagccctggctctgtgcaagtccacagtacagcagctactggggagggaaaacggtgtgtggctacgctgagggtttcttcctggttgatgcgattataatgtgaaaagatcgacatgtgagcccagagcagatgcataataatgctactgcattttgtatttaacaaaacccctttctcgagaaatgtattacttaccttgtgggtggggaattgtctctgaacccaatcaggttagtcactggcccatgactatctcatttttaataaataataattttctcaattcagcgctagccagctcatctgctttcaaaagataagatatgattgctttgtattttttatattaataaccctcagcatgagaggattaactcttgatgcactaaaggcaaactaccggaccctgggagatccatttcttctcaccagataggctgacacatctttcagatgaatttaaaggtcaacgccttgtgcatgaaaagcaggggcctgcattagatggctgagctctagtcaattcttggtcatttgtactgaaacagaggcaagagagagatttcaaaaccaccacgaggaggcccctaaacatgcaggcatttctttcctttatctgtcgattcaaagagcatctattcagggccaagaaggagatcaggtttatctgacttagtcatacagccataagaaagtttccccctctaaaaaaaagaaaagagaaaaaataaagaggtgccttccattggtgaagcgtagtcattcagaacacaagctttgcagccacccacagcccacagcccacagcccacagccactgtgggtcgagttatactttgcctcttagcagctgaccagctttgggtctgagcctgtttcttcacagtggtcagcccccttgtctgcctgataaatgtctgtctgctcacgcacttggctccgcagaagtgagcttgctgggtccatggggatattcactggagattttgcacaatattatgctctggaaaggggtctgcaaactctgatctgagggccaaatccagcctgccacttgtgtgtggacaactagcaagctaaaatggtttttacatttttaagtggttgcatcttaaatgcttatataatggctacataaaatccttaattttgcctcttggcccacaaaacctaacatatttactactggctctttaagaaaatgtttgctcaggcctgctctggagtcctcaaagccacatatataattttaaattttctgatagctctgctaaaagaagtaaaaagaaacaggtgacgttaattgtagtgtgttttctttaacccaatatattcaagtagtatccctgcaacgtgtaggtaatatagaaattgcgaatgaaatattttacattcttttttcataccacgtctttaaaatccagtgtgcattttgcacttaacagcacctcttaatttggactcaccacatttcaggggtttaacaggcacatgtgaccggtggctgccgcattggacagtggcagctctagagagctggaaccaatttatgctccttctgacattcacagggaatgctccgtataaatcttggtctcttcttcctttttaaggtcacatagcacctggatttaaactccaaagctaccccaattttagctggagggaccatattccaagctgcaaatattgtacccacccagcaaatttcctgggatgtgcttcctggggaaagtgaattcagttgctgtagcccttgatttgataaaatgctcctctttctggccttacccttgctcaatcatttccaattccgctgctggttatttaacacgccaggggcagtaggtgcatacagtcctatgctcccagcttatgaggaaatgctctgtccctccacaggcttgatcagcggcctccctgctcctgttctctagatagaagtttccctagttttgctggtctcaactcatgcacaggaggaagccagaagtgccctgctgtgatgatcaatccatatgcatgtttgcctccagcaaaccaaggacatttaattcttggccagagtctcatcagctccatcagtctatgacaataaaatgaatgtatgtcttgatcacaccaggaagtctctgctaccaacacccccaggagaaaacagctccaggctcttgaggctcctcaagtagcaaagtctcatcgctcaggtctcgcatgtcagaatttgccatgattcactcacagcatgtgtcatgtgtatctggtagaatgtctgaaatgcattcttcccatatggcttttcagggccctaagtgtgaatatgaactttgcatgtgaaagatgcttcattttgcattttgtttgcttgtttttgtttttttgagatggagtttcactcttgttgcccagactggagtgcattggcgcccaggctggagtgcagtggcgcgatctcggctcactgcaacctccacctcctgggttcaagcgattctcctcccttagcttcccaagtagctgggattacaggtgcccaccaccacgcccagttatttttctgtatttttagtagagactgggtttcgccatgttaagcaggctggtcttgaactcctgacctcaggtgatccacccgccttggcctcccaaagtgctaggattacaggcatgagccgctgtgcctggccaagacgtaattattaaaattaacaatgttcatctcagtatactgcctaaaattacgtgatatgccaaagtgggtgtatgtatcccactttgaggaatactgatgagaaaggatgttaggcctacagagatcttcatcttcagaagagcacagataagttctggtataatggaaatgacagcgtcttggcattttttactgctgccttcaaacagcagacatcacagcccacgatgatgagcctgctgatgccgacttcctgcattctgtggtacacctgggctcagcttagaaaggctctaccccaactcatacttcttcatggcaagatgaggtgaattcatttctacccatagtcattctaatctgcattttcataacccacctttccattctccaagtgtgactttcatttttaggacagagttattcagtcggtgaatatgcagtccctttaaagggatatttatcacccttgaagaatcttattgccaaatcttaatagtctttcttataacaaaggctcaaattcactatcaagattaagaggtggagcttgaatgagctttgctggagcatctcatgataaaatagattaaagtcttaaaatgggcaacccatcgaggtggaagtcaaacaaatatgcaaaagcgtccctgtattttcctcaggcagtttgggcactgtgggtgagcccagagggtgaatggtgggaagtgggagttaggccacgtggattttccctcaggctcagcggggtgacctcccatgagaagctgaaactatcttaattactttgtctgtaaaatagtggtggtgagcatggggagagcttgcctacctcagaggcttgtggtgaggattacggggaaaagtccatgtaaagtgctcccccctggtttctggcacagaacaaatgaatgaaattcagatccatcatttatgtcagaggtccccaagaccacccccaggttccttgatccccaagtcctaggaagtcctagagtccccaaggccacccccagtttccttgatccccaaggaggactcatggttaagatttattacggtgaaaatatacaaaatgaaatcagcaaagggcaaaggcctgtgagcgaagtccggaggaaatcagttacaagatttccacaatcccctcccaatgcagtcacacaggatgtgcttaactcccccaagcaacatatggtgacaccgtgtgtgaaatggtttctacgagggaagctcactggaggctcagtgcccgagtttttactgggagctcatcgagctggtcacgtagacagcctctgcctgatacatagcaacattcctgactcccggaagaaaagcaagagttcagcataaaccgaatagttcatacaaacatgaggcacttggagccactcttaccagttatgggcatgggaatactctccaaacccaagttcccagatgccagccaagggccagcctttcaggcaggcctttccaacattgcagtctgcaatctgcttcgtaactcttttctgcccaggactagaggtcataaggcccctactaactctctggcttcatccccagtactacctgttaaccaacctgacattcctcccatcaccccgcagatcctggccccaaagccttaccttggtgctagcagctgcctctgttttgaaagctcttcccctgagttctccatgaccaagtcctcacccttttcattgcagatgcttgcgtgttcccatcactgagttctaatttctctaatggaagtatcattctaaagttatcctttgtccttcttttattcttgttcatgggtatctccactagaaggaggatatatttttctggcagaagaacatgcccgtcctatttattgtgttatcactagtgtccactatagggatggacaggtggtaggtgttcaatatttgcctcatggatattgggaattactatatttattgttctgtgtcccaaagaacaaatgaagcccccacacccttcctgtttattgacttaaagtattgtctttgaatgttgaaaaaagtttttagaaaatgctgaacttacagggaaattcaccaaagtaatagtaatatcatgaagatgctcattgcttctgggctttccaaatctcatctttcctcaattgtgccttctctgcatgagcctaatttgaaaaaaacctggttcacagagggctgcttaagaagttgatggttttgtttatactcaaagtcattgtggggacctctattttcaccttttttggcctaggttgtcccagtacttctctcattctgtgattgatgtcatacgtgacaagtgtgatgggtcacttcactggcctctccaggcggtttattctttagctgacttcaccttgctctggccttatgtaaaggtccctgccctctggcttttagtgggttcaacccacaagtctgcaaactttctcaaagagccagataataaattttcagacattgcaggccatccagtctctgggcagctacactactctactctgccattgtagcatgaaagcagacatacacaataggtaaaccaatgagcatggttgtgttccaataaaactttatttacaaaaactgacaataggctaagatgtggcccgtgggctttggtttgccaatcaatggtttagccagtggaggattgggacaagaactcagagggagagaggagaataaatctttgcaggctgctctgtccttccattgggggttacagttcttctcagggagccccctccatgtggccgcgtcttttgggtctggaaattgtttcctcccctggccctctaggcttagatgtgggaaaggtgccccattattactggcatgttgctttatgctgtgggccccttttccttgactctgactgtacttttgctggttcctgcgtccatctcttgtcacatagctcaatttgcgtgtgccatcaatttcctgctgggattaagatacctggcagtgcagggtttcctgggatatgggacctctaaaaccgaaacctagacagtcccagtaaatcaggaggattaatctccctaactggaacccagccctgtctcctcccttggccctgctccaattaccttcattctggccctcagtacccccaacttggataacggctttgctggccagtgactaaatacagtggccagatggggtctgtggccatcgccatgtgcacctctctgctagggcttatttgcccttggaacaaagtctgtagctgatgtttgacaagccaaggagactctagtgtagtcccccagcctactgtagaggctcttcacattatcatattttatactgcataatttttgaagatgatcccttttcttccaaattgtagtacaggagaggtatgctatttttccataagaaaaatcagacttactttgaaagagcagtaggattagcagacactttgaaatattacattaatccagcttgggttgaaaatatccaaaggactgactcatgaaatttcaagtaattgaacttctggactcaaacagacatgagaagaaaaagttatgttccttcaaactatttcagctcagatgattttttcctttttagttcaaaacctgacaaaggtttgcttgatgaggagaagagaccaccttccccacaatgaaagttaacgctataatgataataggagggcttatgactgaatctgtattcagatacaccgattttgtttgcttttagtggcaagcaggtttagcaggttagagaagagggtaatgttttgatactgtggtgaagctgaggagggcgatgtccttagtctgaggagaccagcatgaagccacctttattgccctaaaatgtctctgccttcaaacaagtgggctaaagagggagggcctgatgctctgaaaaggaaaaaaaaaaaaaaacttggccgggtgcagtggctcacacctgtaatcccagcactttgggaggcccaggtggacagatcatttgaggtcaggactttgagaccagcctgaccaacatggtgaaacctcgtctctactaaaaacacgaaagaaacagccaggtatggtggcacgtgcctgtaaccccagctacttgggtggctgaggcaggagaatcgcttaaactagggaggcggaggttgcagtgagctgagaccaccccactgcactgcagcctgggtgatggagtgagaatccatctcaaaaaaaaaaaaaaaaaagaaaaaaacttgcataatggagcaggctaattcaggttcccaggatctagatgacagtaaatatggaagctgctttaaggagatactggagacattttaatggtgttggccgtttcattgtaacacaaatgacttctctgcagctgttcaaggaagactcttttcctatgagtgttggtagatgaagagtggaaactcaggtgcttggcaaggtcagaaagttagtgtcaatgagtgaggaggcttgggtagaagaaaagtctgtatgaagacataagtacaaaccaaaaatcacttttagttgactatgaggcaaacagcagtgcaactgtgatgacagaaggcaaatggtacttgctggggacacatgggatgcatggcctgtggacatctagaaatgaggcctgtccatcaggaggtcaaccttaccatccacggagtgttgccctgtttgactccaagctcaaagctgtcccaaatccagatgctcggtgaaaatccctgatatttgaatggcagcctctgcaagctaaaggccatctagcagatacagtggccatatgggacgtgccagccatgattttttgcagcctctctgttagtgcttgcttgcccttggaacaaagcctgtggctggtgtttaactatcatgggagatactagtgtggctgaaaagtctgtgttctgaacagtactatggcactatagacaaactttcaaggtcaaattgattatcctgtagtttagcaaagcagcagctccctaattatgtcaggaggcaggattatctctgatcatttgagctaggactccagataaaacatcaaaagcaatatttaaataacacacagccatggttaaggattcattgcattttctcttactataaaaccaaaattgtggtggcccattttgttccattactggaagggttttccaggctgttttaactcatacatagtgtaaccctttcccttattacaaaatttcactctgggaaagagcaaagctgtactttgtggtacagtgttatgatggtttatgttcatgaaggtcctacaaaaattcagaaacattcttaatccaaatgatctagaaataggaactggaatacctactgtgctggagctgcttaacccatgaaagacagttgtacacagctcttcacaactccgtattcagtgatttcacattagtagcttgaaattagccatgatgggagcatttatgccctggacattgtcaaaactcagaaatcaagtcatttatttcttggggagctggtcattaaacactcactaggatgcccttgggtacccctcactgctagaagaattccctccctccctgtatttctcccttgaaatctgagccagtcttgcattctacatatatatatatatatatatgtatatatatatatatatatatatatacacatatatatatatatatatatatacacacacacacatatatatacacatatatgtatacacacacattcctatcttctcaaaaattcttgccttttaaaaagttgttatcaaagacaaggaattttttaatcatcagggtagctcagtcttgagacatctgagtccttctgagtagtaaccagtagctgcaccgaagagacagttcaaggactacaaatgatggtagtccttgaatttcaagtccttgggagttcaaggcctatcctcatttgtagttcttcacactgtaccactctttatttgtttaaaatataagagtgcacaggcaaaaatcagctaaatgggagttgtccagaacagtgctttctccagtgaccttactcacccctccatgaggactcagttaattctaatctctattttgctgtttctatgaggtcagaagtccccaactttttggcactaggactggtttcatggaagacaattttcccatgtaccagggacatgggggaggggaggatttggggatgattcaagcacattacatttatcgtacacttaatttctattattattaccttatataatgaaatagttatacaactcaccagagtgtagaatcagtgggagccctgaacttgttttcctgcaactagacagtctcatctagggtgatgggagacagtgacagatcatcaggcattagattttctgaaggagcatgcaacctagatccgttacatgtgtggttcacaaagcacctataagactctaatgttattgctggtctaacagaggtggagctcaggtggtaatgcaagtgctggggagcagctataaatacagacgcagctccactcatgggcccgccactcacctcttgctatgtggtccggttcctaaaaggctgcagatggatacccatccatggcctggggattgggcatccttgtattagattactaactccacccttaaactttttaagttgtgttttcaaagaaggtatcagcatgtcagtctttcctataatgttctgtgtttcttgaagatagggaccttgcctttttgtgtatattgacaattagtgtatattgtcttggcactgacacacagtaggcagtcagtagatgttacttgcatcaatgcatgagtccttcagaatacatccaattggcattcagtgagcagttgttcaaattccttttaattcaggatggtcaaatgtttgtatgaacatttggggaaacatcttaactgtctaccaggcagttagattttaaagaaaagacatgtattcatatactccgacccaggggaagatatgtggcattctgcttaacataatcagttccttgctttccacaccaatttgtgcttgatttgtttcttttcttctagaacttttcagagtgagaacctttagcagaaaaaaaaagcttaacaagatagacattttagttcaatagaagaatttttctggtgtgaaaaagtaaattacaaaaaggactttggttctgaaagataattaataaaaaccttcccatgtgatgacaaatctgacatcttgtctaatgtctggcagagaagaaagtgttgagagctgcacagttggaataaaatgttccactttacagcaaggccgggtaggatctgataattatttctaggcaacaaaagttcatagtctaattgttcaattgacacaacaccaggcctggctctgtgactatgcaccatcagtgaggtcttcgtttaggctttcctgatttcacaggtaaatattgccaggaatgtgggtgatcatggaatgactccctcgtggatattttggactacagctgtacttatagaactttcctttccctcttgtaagcttctcatgggctgtggtaggctgagtaatggtcccgtaataagtctacatcctcattttcagaatgtgtcaaggttacctgtatgacccagatgagtatgatgtaatcacaagcttacagaagggaagtaggaggagccagagttagaaacagaagacgatgtgatgaaggaagagagacagagaaaaacaggtgagaagaggccatgctgctggcttgaatgaagaaggaggctgtgaactaaaggatgtagatgacctagctggagaaaacacattctcctgaaggagttcagccctgtggcttcagactttagaactataaggtaataaaactctgggaggctgaggcaggcggatcacaaggtcaggaggtcaagaccatcctggctaacatggttaaaccgcctctctactaaaaatacaaaaaattagccgggcgtggtggcgggcgcctgtagtcccagctactcgggaggctgaggcaggagaatggcgtgaacccgggaggcggagtttgcagtgagccgagatcgcgccactgcactccagcctgggcgacagtgtgacactctgtctcggaaaaagaaaaaaaaaagaactataaggtaataaagtattttttttttttttttttgagacagagtctcgctctgtcacccaggctggagtgcggtgatgctatctcggctcactgtaagctccgcctcccgggttcacgctattctcctgcctcagcctcctgagtatctgggactacaggcgcccgccaccaagccctgctaatttttatttttattttttttttgtatctttagtggagatggaatttcaccgcgttagccagaatggtcttgatctcctgactttgtgatccgcctgcctcagtcccccaaagtgctgggattacaggcgtgaggcaccgcacctggccaataaagtatttttaagcctctcagattttagaactttgttacagcagcattatgaaattgatacacgcgggcatgttttcctgaaatcagagcctgagaggagaaccaggtacaggtagttttctttgggaggtgatccaggaagcaggagtaaggaaggatgagaaggcaggaaaggagagagaaccaatatattaaggaatccttgagctcactgctgtagacagccaggggccagtgcacagggacctcgagaggcacagggaatgactctcagacgtgtctgtctgcaagaaggcaggtgggagcattcagccagctgtcatttccaatgcactgagggctgtccataggagcattaactccccctcctttcccatctctgctttccctcacattagccaagctcctgcagtgtaggagaaagagccaaagcagaatgcaaagagactgagggcactctaaggggcaagcctgacttctttagaaactcatcgcagcagcaactgagatcagaggttggctgaggtattggctgcagccaccagcatcatcctctattgggctgacccctcagatgacagacctattcatttactgtttcccatcttttgtctctgtggattcaaggtttcttggtgtagaccagacaaggttcccagtgcctgccacatggtaggcattcattattttctcatttgaactccctgaggctactaaggcccacccaagagtacctcatataggggctcctttgtttgacttaagggaaacaggtattatatggcattcgacatcactaatttaattacaaaaaattcataaatagatgcaaataccaccaaccctgagcaggcacatcctctggtttctcctaagggccagccagcaagccaggcattcccagtgtagtaacttaaattcttacaaaactgtatttttccttttaagttttccaagtgagcccagtggcttaatcctggaatcttaatagtaaagagttaattccatttagacaaaaattgtgatttcactgagtgaattgttcttggctctgttttatccaaactgaaggagggcatgcatgagtcctattttgagacaaaacaccttcaaataatctggaaaacaacccagagtttatttctgccaaatggctccctgtttcttgaactggcatgctatggtgtttgcattgaccaaacttctgcgtggagcctttgttcttagaggttgtcatgtgaaaagtttcaatcatctttctaatatgtccttgtctgtgacatggtcccagtccttattttcatccaaagagcatgttgttccttcttctttatttccacaatactttatacataccctctatattaatataactataatattaatgtatacttattatataagaaatatatatcagctatcaatataaataataactagcacataacacctactgtgagccagtttctgtcctgaaacatttgatttgtgtttactcattgactcatacaaccaatgggagtagacacaattattagttgtgttttgcagatgaggaaactaaggcaaagagaatttaagtaacttgctcagggtcacatagaaactaactggaaaaattgagatttcgacccagttagtctagcctgcgaatctttactctgagctactttttaactgattctcaatgtatagtcacataggttgtagtttattatatgtccatgtgtctgtctttccttctagataataagttttttaagggttttattcatttttccatctctagtatctaggccagagcctggcagataatagaaatgttaaattttcactaagaaaatcaattttaaaatgaacctgatgatgctgtcataatggcagatcaaaatgtcccataatttgaaagaggcaattactaaaacaatagcaaaaaataaaataaaacaaaataaaataaaaaatgagagacaatgcttatttatgccaaggagaggagcacttaggacactcattgccacatcctgactctgacagccttgtcaaagcattccaaagccatgaccttcccttattctcccttccttccccacctcgccttcaaattccctctcctattcctttctaactcctctattttgccctcttcattggttttcccaaattatatttacatgttaaaataccaagtaaagggaacccatattttctgagtgtctattgtggggccaggctatagtagactgcattagttcccaatggctgctgtaacaaatgaccacaaatttagcaatttaaaacgaacatagtattgtacagttttgaatgtcagaagttcaaaatgggcttcactggactaaaatcaaggtgttggcagcgatgcattcttttctggagtctcatggggagaattccctttatgccatctccagtttctaggggccacccacattccttgactcctggccccttcctccatcttcaaagtcagcaatgtggggctgagttcatctcataacatatcactctgccctcaccttcatcatcacatctctttctcttatcctttcttccattttcaaagatacctgtgattacattgggtttacgtgattacataatccaggataagcatgctgttttaatgttagctgattcccaaccttaattaccctttgccatgtaatctaacatattcacaggtcctggggagtagggtgaggacatctttaggggactactgtctattctgtttgcgttatctcattaaagcttcccagtgaccgtttctctagcaaagagcatgtgaaggccattcactctgaattaatttaccaaaagccagagaaatcaccacacagccagaatttggacttaggttagttttggctttttgccccatgcttttccttgttttattgttttcttgtgcttcacttttttttttttttgtacttcacagatactgtatgttttacaaattgaagatttgtggtgttgaagtcaaaataaaaatgtagagatgaatctctaaatttagcatttcatttgggaagaaagacttgcaatttggggcatttatgcagattaaatagtctttggtatgttcaaagaacaaagagaaagttggaggttttgtaacaatgaaaaatgttatgtattgctctttgagaaagttcattgacactagtaaggttctgggaagctggcaagcttcagctggtgagtggcatcagtgagaaaattagtcctggagttgcagcaaattatcttgaagctatagataaaactgggttcaggttacagcagccaggcttgcagagaattacattgttggagcaatgctttgtgtccctagtgtgtttttgcctggcttcttgactttgctttagttgggtatgacaagaataacccaatttgtaggatcagctttcaccttgacaactctgcactgagcaagtttatgggtgctgtttttccaacagtatgtgatcactttgtgtctctgtctcatgttttgataattctcccggtttctttcctttttttaaattattactttgtctattttggtgatgtctgatcagtgacctttgatgttactattgtgatttttttttttttgggtggggggaggcaccacaaactgtgcccatataagatgccaaacttaattgataagtgcgtgttctgactgttccaccaactggccctttactcatctgtctccttctcctccaaacatcctatttcctgaaacacagcaatattgaagttaggccaatgaataagcctacaataaagtactttctttgcctctaagtgttcaagagaaaggaggagttgcatgtctctctctttaaatcaaacctagaaatgattaagctaagtgaggaaggcatgtcaaaagctgaggtaggctgaaagctaggtttcttgtgccaaagagtaaagttgtgaatgcaaaggaagagttcctgaaggaaactaaaggtgctactccactgaacatatgaatgataagaaagtaagacagccttattgctgacatggagaaagttttagtggtctgaatagatgatcaaaccagccgcaacgttccctcaaaccaaagcctaatcctgagcaaggccttaactctattcaattttctgaaggctgagaggtgaagaagctgcaggagaaaagttggaagctagcagaggttagtgtgtgacatttaagtaaagaaacgatccctataacataaaagtgtcaggtgaaagccaagcacagtggctcacacctgtgattccagcactttcggagaccaaagcaggtggatcacgaggtcaggagagcaacaccatcctggtcaacatggtgaagccctgtctctactaaaactacaaaaattagctgggtgtggtggcacgtacctgtaataccagctactcgggaggccaaggcaggagaatcggttgaaccagggagtaggaggtttcagtgagctgagatcacaccactgcactccagcctggtgacagagtgagactccgtctcaaaaaaataaataaataaaataaagtgtgaggtgaagcaggaagtgctgatatagaagctgcagcaagtcatccagaagatctagctaagatcattgatgaaggcggatacattaaataatacattttctacatggttaaaacattcttatactggatgaagatcccatctaggactttcatagctagagagaagaagtaaaggacaagcaaactcttttgtctgggactaatgcaactgatgactttaagttgaagccaatgcttattcaccattgcaaacatcttagggcccttaagaattgtgctgaatctactctgcgtgtgctctacaaaaggaacaacaaagcctggatgacagtacatctgtttacaacatgatttattcaatattttaagcccactattgagaactgctgctcagaaaactatattcccttcaaatcttactgttcattgacaatgtacctggacatccaaaagttttaatggaggtatataaggagattagtgttgttttcacacctgctaatataatttccatttttcagcccgtgaatccagaagaaatattgactttcaagtcttactatcaaagaaatacattttgtaaggctacagcttctaaagattgtgattcctctgatggatcaggacaaaatgagtcaaaaacctgctgaaaaggattcaccattctagatgcccactaagaacatttgtgattcatggggggtggttaaaatgtcaaaaataacaggagtttagaagatgttgatttcaatcctcatggatgattttgagaggttcaagacttcagtggaggaaggaagtgcagaagtggtcgaaatagcaagagaactagaattagaagcagagcttgaatatgtgtgtgaattgctgcaagctcatgataaaaatgtgaatggatgaggagctgcttcttatggatgagctaagaaagtggtttcttgagatggaatctaatcctggtgaagatgctgtaaacattgttgaaaagacaataaaggatttagaatcgtacctaaacttagttgataaagcagcagcagggtttgagaggactgctttctattttgaaaaaaaagttctcctgtgggttagatgctaccaaatagcatcacatgctatagagaaatcattcgtgaaaggaagagtcgatagattggcaaacctcgttgttttcttattttaagaaattgccacagcctccccaaccttcacaaccgccaccctcatcactcagcagccaccaaaatggaggcaagaccctcaccagcaaaaagacaaccacttgttgaaggctcagagatcattagcattttttagtaaaaacgtatttttaaattaaggtatgtacattgtttttagaaataatgctattgcatacttaataggctacattatagtataaacataacttttatatgcactgggaagccaaaaagttcatgtgactcactttattgtaatatttgttttattgctatggtctggaaccgaacctgcagtatctccgagggatgcctgtacatgcagcttccctgtttacagtttgaggagaatatgttgggtagcatcttttagaaataaagtctaggatgttggttcaaattttgtgtgaaagcaacaatagggccaggtacggtggctcatgcctgtaatcctagccctttgggaggctgaggcgggcgaatcgcaaggtcaggagttcgagaccagcctggccaacatggtgaaaccccgtcactactaaaaatacaaaaaattagctgggcatagtggcggatgcctgtaatcccagctactcgggagactgagtctggagaattgcttgaaccctggaggcggagggtgcagtgagccaagattgcacctctgcactccagcctgggtgacagagtgagatttcgtctcaaaaaaaaaataaaaagaaaaagaaaaagaaaaaagaaagcaacaatgggaccgacgaaactaaaagcagtctccccttttacctccccaagaactgtaaaaccatttgtaagtgtctgtgaccttaatgaccagaaacgtgtcaggttttctgtgttcctggggctgtaaaacaccaggaacattttaaggaggtcagactcagcaggggcgtggacatgagtacatgcacatgtgtgtacgtgtgtgtgtgtgtgtgtgtgtgtgcatgcacatgtcctggaatgctccattcctccatgctttccctgtaggcagtatgcctttgtaaacccttccaggactctgggtttgtgctccctgggaggataaagaattaatcaaaatacactgctgcgatatttttacatcctgcaagtcagaggcagtatcctttcttcctcacaaatctaagaccctccaaattgatctcaatacactgactttaacaagagtaaaccagagatgttttatggcagggataaagtaactatcaaccaacactaatgacaagaaagcaaaaagagttggagagaggaaagcataaaggatcccagagacactggggtgttggtttggaaaataccttcttggagctggtttaagaggggatggaacctgagagtgttctcaacctcgtgagattaattatttgtggcaggaagtttctctctttatttgtggctgctttggagacagttgtgtcatgtttttcttcagtcctgatatttttcactggcctctgggatatatctgtgatgtcagtggtatcaaagacttttctgcccttgttccatggatgtttagtgtacaatcagctgctgcaacaaacaacaccaaatctcagtgactttgcacagcgttccgtggatgtgtcttgtggggcggttctcccgagtaactgtcttctgtgcaatgactgattctgggctctttctattggatgactctgccaccttgggagtccttccttcctatttccatggataggagaagagaagatatcatgcaggacattcaggggccatgtctagaagacgtgagaatccttccacccttattctgttggccagtgcttagtcacatgtctaaaattgtaatggagcagcagcaccatgtcctattgtgagaagtagccagagactaatctcaatgacagttcttatagcttgaaaaggtatttgcaaaatctaaagcaaaagttgccaactcgaatgcctagatgtccaagcaagtgtttaactgaattgagtgagcagaaacaagaaccagggagtggtgctgagaaggaaagcttggagaggggcactctacataacatgacaatttaacttgatgacagacttctctggctaaactaaccacatctgctggccacatccatcccttatgctgccagttggcaacctacagtatgggagagaaaaagaaaaaatcctttctctggaagcaaactccaaagttgggtatattcttgaatcagtacctgtcaggataaaaaaaaaccctttctttttaagaaagaacgaaagttctgtactacagcaaataaatggaagctaaaaagaaaacctggtataaagagtgtgatttaagaatttgctttctgtgcatacatttagggtagtggctcttgcatggaagagagatctctgagctgctactttaaaggatgcttggtgtcctacagaggtaacacaactcaatcatatcaggcactgatgttctgatggtgcagctgatcctgagatgcaaacaccccatgatcttctgctgtctgattccctgctatgtccctgtatgtagtctaaacagtctattcactgaacagttttttagtaacaacaaaagtaataatatgttggtaatagtttgtcaatgtctaccctggagaatatcagtgaatcatgaatatggatttaaatataatacatagaaataataatagcaagcatttattgagcaagtactatgtaccaggaactacttaaggctctttacaataattaactcacttaatcctcataacgggtgagataccattactcctgcttttcagcttagaaaactgagacacagaaggttacttgcccaaggatagcccgctggtaaacgagattcacactgaaccaacgtggcttaaacctgtgcttatagtccgtctgaaacgtgaatctttgtagcaggctgatggtaatttttagataatagaaatcttttgttaatcatagaatttgattattgctgtgctttcaaaggtgtcttggttacctctcatttcttaggtactcactgatgcataaatggacaaacatgtcatagagtaagactatgattgccgtggcattaaagataaatttggaatgatgctcagagcatatattctagaaaatttacagaggatttggggaaaactatgtccaggtagtatttttatgcatgtgacatctcataatattggagaaagggcttgcctggttttggagtaatgtccaagttctaattcttacagcaatgaggggtgctgctttactgctttccatccccttaccaaagttactgtgaatgaaattgaagagcggatatcggtggcaagttcaagcatagatactgttttgaattctcttaagaaattaaagggcaaggctgggcttggtggcttatgcctgtaatcctagaactttgggaggccgaggcaggcggatcacgaggtcaggatatcgagaccaccctggccaacatgttgaaactctgtatctactaaaaaaatacagaaaattagctaggcgtggtggctggcacctgcagtcacagctacttgggaggctgaggcaggagaatggcatgaaaccaggaggcggggcttgcagtgagccaagatcgtgccactgcactccaacctgggtgacagagcaaggctctgtctcaaaaaaaaaaaaaaaaacagtaaaaagaaatcagaagacaatagcagtaactagaacattctactattattgactagtaagatatttagcttttggggaagtcctaaattagcctggaatcatttttaaatgcagttttgtaatttcagtgatgtgttacatgaaactcaaagagccacaaaataattcacgtgtaagcgaagagtgtgctggtttaaaagatgagtctgcattcttctccctttatgcagataattcgtaatcatctttgagatcccagcagaaatgtctcttttgtggttttgctttccttgatgctctagatgaagttagacttccctataccccaacttttacatgctcccagagagatctatattttcctttccagttaaattttaatcttggtgaatcacttaaattatgatttgttaatgcctcttttctttttgagaccataattatatttaacaattattgactccttatcctgtgtggcacctttctcattgctttggacaatgtgtagcaaagtcctcactgaatcccaggagtctaataggtatttgtgaatgaggagtgagtgaatgaatgaatgatttgactaattcttacctcactaagtcacccatggcccaggagggtactgtgtacctttatgttacaaatcatttaactttaattttgactggtaggtgaagtgtcccaagaatttgtaaagataaaactgtgcctttggggcttctcctactgctcccctcttccctaagagtcagcagctggaaaaggtttatttattttttttattttgtaactgtagaggaatcctgaatgggccctgcaaagtaatctcagagattgagccacacatagacaaagatggagaacacagctcacctgcagagtgctgtttctcatcactaactgtggtttctctcagtcctgactttttatgctgaggattctgggagaaatttcaccttctttacttcctacaggatatccagtttcctggtctgggagctgagagcagaattagccaattggaaggttaacgcataattgtaggcactgggtgtatggaggagacccttgaccatttgctatttaactgaattaatgttggccagttatagattttctgtttgcaaaattgccagcagatttttctgactcctggatctgcatcctgtgtatgtgccacttgggatgccagcattttgattgcttccagagcgatctaaccagagcctgctctcaagacaagggaatccatgattcacaagcggaaccgtacagatgccagaccacagcgttcttttcactttgatttgagggagatgatgttggtcagggtgatgactcccccatttcaatttctctgatgttgttcaggccagccacacggtgaacctcctgagattgattcttgctcccttctttggggttcagtgcatttcagagggctggtatttagagagaagccctggttccacagcttccaaccttttgacactgctttgagttctctggtggggatgataatgaattttcttcaactgtctgtgtgcagtggttaggattttgaggtctgatattgaagttttgttttctaagaaacacacagagtcgaggatttgagtgcaagtaatttgagtgatggcagaaattggtttaagaaaaatactagctggggccgggcacggtggctcacacctgtaatcccagcactttgggaggccgaggtgggtggatcacgaggtcagcagatcgagaccatcctggcgaacactgtgaaaccccgtctctactaaaaatagaaaaaattagccgggtatggtggcgggcgcctgtagtcccacttactcgggaggctgaggcgggagaatggcgtcaagctgggggcggagcttgcagtgagcagagatcatgccactgcactccagcctgggcaacagagagagactccatctcaaaaaaaaaaaaaaagaaaagaaaagaaaagaaaagaaaaatactagctgggtgcagtggctcacgcctgtagtcttggcactttgggaagtcgaggtgggtggatcacttaagctcaggagtttgagagcagcctgtgcaacatagtgaaacctcctcagtacaaaaaatagaaaaattagctgggcttggtgacgagtgcctgtagtctcagctacttgggaggctgaggtgggaggatcgcttgagcccaggaggttgggtctgcagtgagccacagttgcactccagcctgggcaacatggcaagactcggtctcaaaaaaaaaaaaaaaaaaaaaaaaaaaaggaaactttaaaagtcaaaaaaaatagaaaaaataccaatagggaatgaggaaataagtcagggaagagaaggcaggtaatgaatgtgagttatcaagctagattctctggtggactttggcactcaatcccaggtggaaactgggagacaaaatgcgtatctccaagtgatctcaccagaggggtgagggaattgggatatttacataccattccccatcagttattggttaaggaccactcccaggatgttaatttccaaacactctcttctggcactatgctcagataaaatacccttccacaagttttagagacatatctcgtacaaagaagaaaaaatgcaaagtcctgcacgttgacacagaaggtctgaggggaatgggtaggactctgacagagttcctttgaggacacttgaacctagattcagatgctggcttcacccattccaactgtatgatcttgggcaagcttgttaacctttctagaatttcgagttcgtcttctataaaatataccttataacattacacatttcataggcctgctgtggagatgatgcatatggtgagtttagcacattaatggccaaatactaagggctcaaaaatggtagctttcatttgttaagtgttacggagcctcttctctgtcccagtatgtgtggtaggtgctcagtagaaccagtggttggttgttggggggaggtaatacctgtttttatggccttatagcctttgcgtactaaaccttaagaccatttcttatttcactaagtcacaccttgcccaggagagaatcgtatacatctcatacattatgttccaaatcacgtaacctaaatttttgaccgctggatgaagtgtcttaagcatctgcaaagacagaactgtgcctttgaaagcaattgtaaattttaagttttatagtagccaagtttgcaaaaggaataagaaactggtgaaattaattttaataacatatatttaatttcatatgtaaaatattgtcatttcaacatgtaattaatatgaaattattgactattttacattcttttccttatttagacattgaaatccagtgtgtattttatacttacaacatgtcagtttcagacctatgactgttaaagtactcagtagccaccggtggttcatggtcaccatattgggccacagtgaaggcttaacaggtcctggattccttttagaagtaaattccaacagaatagttccattttctctttcctcctcttcatagatgacaatgcttctttgcttgtataaaaatgaagttggttttagcttaggcatcatggaaaattgacagtttctgtaataaaatttcacacatggaaaccatggtgagaatcttagcaggtgtaaaaatctgacgaagttatttctttaactgcaatttaatggaaactgcagcagctgttccatttgcgtattctccaaatctcagtgccaaaaagaattgttggcagccactggagaagtttcaacttacctcttcatttgggaaatgaaatcaaaacctcagcttgtttctaaaagttgcggatttggcgaaagttagcagggcaaacacataagccgctattaaaatattgatggctttggttttctcaggtgctgctgctaacatctgcagaagatttggactgcactcctggatttcagcagaaagtgttccatatcaatcagccagctgaattcattgaggaccagtcaattctaaactgtaagcaatgtcactcaaagatgcttttagactcttctcatatttgaatttactaatgtttatgactgtgtctcaggatgtggtatttcctaaactaagtgttttctgattatttttcttatgtcactgcttgacccaaagtggaaattcttgaatgagggcctggccaacttagaggttaatagagtgatatgcatctctttttagtattttatcatcagtgggtatctccatactgctgtcagaaaagggggctgtcagcctccaatgagagttgtacactgtgcaaaggaaatgaaattcatttcccctgggcagatccccaaaatcaaaatcattgccttctcgcagattgctgttctacctgtagtttctcatacatagcattagatcaaaataatggtgagagtatgacattggcttctgggaatttttagacacagacatcaaaaactcttattcttaaggctaataagatgggttttagaaagattcaaaacctctactgattattctatggattaagctcaactcatcctgaattccaattgatttatttaaaatatgcatctttcatatctgtggtgatgatctctttttgtttttaatgtcaatattatattgctttatctttaagaagtgttagggtacattgctaaatgcataacaagtacagttttagtgcaatagaatttaaaattggtggtagacaaatagctatttcattgtaggctcttgagtaccttgcttaacaactggaaatgaagaatatggaaacaactgatctaaactgatcagatgcagtcgggtgtgatggctcatgcctgtaatctcaccactttgggaggccgaggaggatggatggcttgaggccagaagttcaagaccagtctgggcaacctggtgaaaccccatctctactaaagttacaaaacttagctgggcatggtggcatatgcctatagtcccagctacgcgggaggctgcggcagaagaatcgctttaacccaggaggtggaggctgcagtgagccgagatcataccattgcactccaacctgggtgacagagcgagactgtgtctcaaaaaagaaaaaaaaaaaagaagaagaagaaaattaaaataagctgatcatacgctccaaggtcttttcaaggaaggtgattccacattggctcttatggtctcaggtttacgttccacgctagctaagttcctttagtcctatgctatgtggctgacaagtttaaaggaaagacaagaaaaaaaaaaaaaagcacacttgactggattattctgtgaggctgggacacactctaagagtcgaaaggaacacaataatgaagatgcactgttgagcatcaagggagctgtccaaggtgaagcccgtgcacctcccgatgaaatgacgccaatgaaatcatttcaataattagtctgtaatgacaaggtgcagggctggcacaataagtgaattccaatatgtgatttcctgctcatttgatctctgagtgtgactcctgggtcaggccattaggaaccctcctttgtcttttcatttttgtatttatcagaatcaatatatttcaaacagaacttgatttgtgagaaccatttttctggctctcctctcctctcttcctctgtcttccttttattttttttccaagtgattatcccaaatggcatctatgttaacatgcttggaaatgcgaagcgaccctgagtatggaaattaatagagttggtatgcaaagtagacctataaatgtgattgcttctgtaatcttcacgatagcaaacagtttttaattcgctgctgagaagctggaaacaatcatactttggggggatctttttaatttaaagtaagccatactgtacattgcagtatcacagttgtgtgtgtgtgtgtgggggggggggcggcggtgtgcgtgtgtgctttaatcccctaagtaattaagtgggttatggttgttgcttctgggtaagctagtaaatgctaaatgggactaggttcattatcaatgataacacattcagaaaaagtcagtgatatgagaattgaggacacttaaatttttatgcttgtatatgagttgttgggtcagcaaaatttgattagcccctcttggtgaaaccgtatgtccatgtatattactaaggtaaaaaaaaaaaatccaaagcagatctggttaggtactttcaagttcatctcaaagcaatgaacatattatgagtatagagcctgcagataaggttaatggtgcctaaatgaggaagaaaattgtcatagacttgagaatgcctattgaaaatagtttaggaaactctggatttctagaagtagtagcagtgctttgctttattccacttgcaagtagcggttcaattgaataaacttttatacctaaccaaccaatattttaagccagtctcactctcccctctctctcattctcagtttattttgcgtatttcttataatgcaaaacaaaaaccttctgtctctgaaaaacgtgattaatcaagaaaccaatgagtgaagtgtgctatcaaattgaagactctactggcacaaggctaaatctgaatgaaaaacgaaaagaaccaaacagaaccagaaaatgttaaatgcatagattccatttcctgaatcattgtataccaaagatccaggaaatggttagggatgttttagtctcatataaatataggtcagtgttgtacacagtgagaaaactagattagtagcatcatcttgtgccctactcatgacatttgcacttcatatttttcctttatctttgcaatatttaagagctttggttaccaatcattgtgaacttttgtgttgcagggggtgtaaacacagcataatcaatcaattgatgtctacactcttcacttttctttaaagttgtctgaaagtgctgtctctttgcctgacagacatagtatatctacccctaccctagacttgtgttcatccaattgtgtgttcagcttttagcaggttatggggaatgtttattctgtggatggcttcctgctatctttgttcagacagtaatatttccttttatcctttttcatcttcctcctcaattttcaatgacttatctttttctactttaactgttactaatggtcacctccactccttttatttccctaatattttattcactgttatctctgatacatctttctctcagttgttctgaagccttttatttgcttcacatctgaatcactctttattctactctcctttccactaactggacttgcttttgtcttaaaaacgccatttttcaacaatatgctgggaccaaaacatagcattcagctatttcttctaacgtaaccagtgggctcttcactgcatctttcagagagtgatgcaaagctcccaactcagggaaacttgggtaaaacttccttggcttcatctcagtcttgaaagtttatctgggaaaatgtgattcttcccatttgtcaatgaaaaatacaagaagaaaggagaagtcagcttagaaggcaaccactcagaaaggaggcatccatttaaggtctttgaattctgaaaggaatctgtgaaaagtttgtgggaggtgttttctggaggcctggcacccatatctccctcaaattgcccagcatggtagatcttgcttttccccaaacacgacaattgtgtgatctgggagctgacatcttagtaccaccagaattggacagcaaccctggttacatcatgacacccagaacagaagatccccagtcttagaagaatagctgtcttgggcaactgaccagccacccagctgggatgggaagatcccaagtgataaaatctgactatcctatgttctgcaaaattataaaacaggatagtctgctttgataccatcagctcagacagattttttccagcaaatggaaaaatgtgtggtcattgagctcattaggagaaaccatacccttgacctccagcctctattagcaggggatgagtgcagtctttggtgtccagaaagaagatcctcattggccacatagccaccattagaactgtacttttttttcttacccttgttcattctttatgggtcattcctcttaggccacccacatgcaaacatagacacataggtagagacagaaatcacagcatctgaatttacctacaatacaacttgcatcacatgtttaggaaagaacctgcattaacaagagcaggctaggctaggccatggtgtcaaacaactctagtgacttaacacagtgaaagtttatttctcactcagatcatgcagatgcagtcgggctgctctcctgggtaactctcctcccagtggttgccctccatgcaagaacctgatggccgaggctacttccaacttggtcctaccatcttgtagcttccagcttttatcactgagctggcagacaggggaataagaaagactatgaggaggtcactgcaggtgcttaaatacctcagccccaaagtggcatgtatcatttctgctcatattctaagatctaatcatgtcgccaacctaactgcaaaggagtctggcaaacgtagaagaacacatgggtatcgatgcaggatcacagtctctacaaagatcctaacaaaatgatgtcgcctatatcagaaagagacataaatagagacagaaatggaccacaaaggagccagctgtcttggagtaaccaaggcctacataggatgaagttagtcagtttaagcaggagagcaaggtcgtgcacctgcgactatgtcctgctttccttagtagagaaatattcccactgaacagaattagcttcttagaaacactataagctcctctccctgtgccatcttagaaacactaggggagggacagcacctactcatggactccagttgcttcctccaattggttacaatactgtggttaagatcacacagttttaaactcatatcgactagaattcaaatgtgcacacagtcatctattagctctgtggccatgagtgagttattcacatcctccaagtttgaattatctcatctccaaaagaagattaatggtagtccctgcttctagagctaatgcctcaactgatgggaaacatgcttagaacatagtcacaaataaatggaagctgctattattattattattgtccttataatttctgctgttactattattatcattactttcattcatagacctcagctagatccacttttcttataatggccatctgaaattggctttaagaagaaaaatcatgttggccattaaaaatacaaacaggtgaagaagcgactaaagcagtgattgtagggcatttgaacttcatggaccagtaatttttttaaatcctagattgatgagagtgtattttaaaaaattggtaagacttggtatgaattttttaaaagtaagtaaatgaagggaggggaaaacactaccgccatttacttttgccaggctttccttttaaaaggtcacttggcatcaaaaataaacataaaagaagtaaagactagttacagaagaaaagtcagttctttgagtaaattttgctttgtgaaaaatgcaccaaatattcttatttacttcgcttttgtggaaaccattgatctaagggattaggttgatgtcaccctttttgctcttcacttttctgatacttttctgaagttttaatatgtcgttgtttctgaagaggcaggggtatttcttaggagacattttcatgaagggactcctgtccatgttgacaaaagagagtgagtgtttctagataatgtgacaatcatatgcatgttaggaggtgtattagcctattttcatacttctataaagaactacctgagatggggtaatttatacagaaaagaggtttaattgactcacaattcagcatggctgaggggtggcctcgggaagcttacaatcatggcagaaggtgaagaggaagcaaggcaccttcttcagaaggtggcaggaaggagaagtgctgagataaggggaggagccccttataaaaccatcatttctcacgagaactcactcactataatgagaacagcatagagaaaactgcccccgtaattcagttacctccagctggtcacccccttgaaacgtgaggattatgggaatcatggggattacaattcaagatgagatctgagttgtgacacagagccagaccatgttattccgcccctggttcctcccaaatctcatgtccctttcacatttgaaaactaatcacacattctcaacagttcccgaaagtcttaattcattctggcattaacccaaaggtccaagtccaaagtctcaactgagacaaggcaagtcccttccacctagaggcctgtaaaatcaagttagctgcttcctggatacaatggaggtacgggcattgggtaaatacactcactccaaatgggaaaaattggccaaaacgaagggtctacaggccccacgcaagtccaaaatccagcagggcagataaatcttaaagctctgaaatgatcttctttgactctgtgtctcacatacaggtcaccctgatgcaagaggtgggttctcacagtcttgggcagttccacccccatggctttgtggggtacagccccactcccagctgctttcacaggctggcgttgagtgtctgtagcttttccgggaggacagtgcaagctgtcaatggatctaccattctggggtctggagggtggtggctgtctctcacagcttcactaggctgtgccccagtggggactctgtgtggggatttcaaccccacatttcccttctgcactgccttagcagaaattctccatgagggctctgcctctgcaacaaacttttgcgtggacatccaggtgtttccattaagcctctgaaatctaggcagaagttcccacacctcaattcttgacttccgtgcacctgcaggcccaacaccacgtgtaatatgcctaggcttggggcttgcaccctctgaaacaatagcctgaactgtattttggccccttttagccatggccaaaatgcagggctccaagtcctgagacggcacaaagcagcaaggccctgggtctggcccatgagaccattttttcctcctaggcctcagggcctgtgatgggaagggctgccttgaagacctctgagatgccctggagacatctccctcttacccaccagccctgttacaccattgacttggcgattaacatttggctcctttttatttctgcaaatttctgtagctggcttgaatttctccccagaaaatgtttttttcttttctatttcatcttcaggctgcaaattttccaaacttttatgctgtgcttcccttttaaataaaaattccagtttcaaatcttctctttgtgaatacgtaaagctgaatgcttttaagagcacccatgtcatgcttgaacactttgctgcttagaaatttcttctgccagataccctaaatcacctctctcaagttcaaaattctgcagatcactagggcaggggcaaaatgccgccagtctctttgctaaagtacagcaggaattacctttattccagttcccagcaagttcctcatcaccctctgagaccacatcagcctggacttcatcgtacatattactatcagcattttggtcaaagccattttacaagtctctgggaagttccaaactttcccacatcttcctgtcttcctctgagccctctaaactgttccagcccctgcctgttacacatttccaaatttgcttcctcatttttgggtatccttatagcagcaccccactctactggtaccaatttactgtattagtctgttttcttttctttttcttcttctttttttttttttttttttttttttttttgagatggagtctcactttgtcgcccaggctggagtgcagtggcacgatctcagctcactgcaacctctgcctcccgggttcaagcgattctcctgcctcagcttcctgagtagctgggactacaggcatgagccaccatgcctggctaattttttgtagttttagtacaaagagggtttaaccatgctggccagactggtctcgtattagtctgttttcatactgctgtaaagaactgcctgagactgggtagtttataaagataagaggttcaattgactcacagttcagcatgcctggggaggccttagaaaacttacaatcatggtggaaggcagagagaaagcaaggcaccttcttcacaaggaggcaggaaggagaagtgccgagataagggggaagagccctttataaaaccatcagttctcgtgagaactcactatcacgagagcagcatagaggaaaccacctccatgattcaatgacctcccccgatctctcccttgacatgtggggattatgggtatgacagttcaagatgagatttgggtggggccacaaagcctaaccatattaggaacatatgttggcatgcaagcttctgtgagtgtggacaagtatggcctccctggccttgataactgacagttactgtgtgctccctagtgtgttgagggccacctcgaacctcacaacagctcttaggggaaaggtactctcatctgcccattttacaggtgaggacatttaaggctgagctaggtgaaacaatgaacctgagatcatactgcttataattggtggtgtcaaaatttgaacccaggattttagggccctggttttcatccatagttctgtggcctagtgtctcttagtttttttgatgttggtggtgatacatcaaggaaatttgccggtgtgttttcccatcacttttatcaaccagggtgagatagagagaactgctgctgctgcgtatttgttgcttttcatagccaagctcatcctgtctctgtattatagaagaattagctttttctattctggatggacccagggccagattgtccatgacccttaactctcagctttccaccctctctgttagtttctttcaccaagacgttacttggtcatgccaccatgacactgaccttggttagcagccaggtcctccatggagtgtgtggaatcacattaatcatatttgtacttaacatacatgagtcatggcttttgagggtgcttttaattgactataaatcaagcaaggaacttgaaaaatgaaggcaattaatgaaaaagcatgtgagaggtgttttgcatcctaagggaggaaatacactgtcagtgaatttaatgtcacaacaaaggctcttttgaccctgctgaaaagatttcatgtggatagtaataaatggatgaactttgcagcctcacaggtggagaattgcctgtttcctgagttcaagctgacttaggcttttatctgtctacattctctatcttgagaacttcctagattcttttacttttgctttcatttcttgtgatttttaaaaataacaatgataattcttttcccattttctggtcattcttcacacatcctttacatattttatacaagcttgtatttactttcaggttgggagactgattaattgattagtgaggttatgtaacgtcccctgaactgcagtctggacagagctggacaaggttggggtttcaagtagtatatttgttttaatctgttgcgatgtgccaaggaaaattattctggtattgcctaattcactctatcattatgaagttgacgatacatcgggtcagaatgtggactcctatttacattaataagagtttttcctatatttaaacagagctcagtagaaatgttatgctttcacaggttttcccttccctcctaccaatccatttgtaacaatctagtagtaagtcaattaataatgattagaaacctcataaatgcattatcctacctaacaaatgtgaaatactataataaaatgacgtaagataagaaatgaacatatgtacacatcaaagacagatgtaacaaaatgtttagagatccttccattggacttgggtcctaacttgttctttaaagaatgggaaacacaagaagtaacagagtgagaaggacttctcagacgaggaacatgaacacaggtggagttcccttggcctaagttttcttatcagtagaatggaagagataaatagaccagaggtatcacactgtcagcctttgggctaaatttgcctcacagatacgtcctgtttggctgcttagtgtgagaatttgaggtgtttgataaaaggaatttgtcattaacatttagaatttcacctttagaaattcccaatttctgggtagtgttgcgtcttcagagcagacagagatgccacagttcagctgcctgggttcaaatctaaggccgatcctttaccaactaagtaactttggcaagttgggaaaaacaaaacaaaaaaactcactgtggttttattttctcatctggaaaattaatattataatggcagcaatctcaacagtctgttttgagggctaaatattaatctatgtgtgataactgctacattgtgtaattattatcattattatttgagatggagtctctccctgttacccaggctggagtgcagtggcgcaatctcaactcactgcaacctctgcctcctgggttcaagctattctcatgcctcagccttccgagtagctgggactacagaagtgcaccaccacgcctggctaatttttgtaattttaatagagcaaagttttgccatgttggccaggctggtcttgaactcctggcctcaaacgatcgtcctgattcgacctcccaaaggactgggttaggtgtgaaccactgcgctcagcgggaattttttttttttttctttttaaacacaagtcaagtgtagtagtgagaagtgcggaaggggtagaacaaggagtttgatatgtaactttatccttattaaaataccaatgaaattatttacagaaaaagaaaaaaaattctaaaatttatacagaaccccaaaagacccagaacagcagaagccatcttgagcaaaaagaacaaaattagagttatcacgttatctgacttacagttgtactacaaagctatagtaactaaaacagtgtgatactggcataaaaacagatgcatagaccaatgggacagaatagctaacccagaaatctatgcatttacagtgaactcatttttgacaaaggtgccaagaacataccttggggaaaggacagtcttttcaataaatgctgctgggaaaactggatatccatatgcagaagaatgataatagagccctatctcttgccatatacaaaaagcaaatcaaaatgaattaaagacttaaatctaagaactgaaactctgaaacgactacatgaaaacattgggggaaatactccaggacattggtcttggcaaagatttcttaagacctgagaagcatgggaaactgaaacaaaaatggacaaatgggatcgtaccaagttaaaaacttcctgcatagcaaaggaaacaatcaaaatcaagagacaacccacagaatgggagaaaatatttgagaaccacccgtttaatgagggattaatagccagaatatataaggaagtcaaacaactcaatagaaaaaaaaatctcattaaaaatgggcgaaagatatgaattgacgtttctcaaaggaagacaaatgggtaacaggtatatgaaaaaatgtccaacctcactaatcatcagagaaatgcaaaaaaatgtatatataaacatattctctccctgcagttaaaatggcttttatccaaaagacgggcaatcatgagtgctggtgagggggtggagaaaaggaaaccctcatacactgttggtgggaatgtaaattattacagccactatgcagaacactatggatggtccccaaaaaactaaaaatagaactactatatggcccaacagtcccactgctggatatatatctaaaagaaagggctggaagggtcctggggagggagaataaagtggggttggttaatgggtacacaaatacagctagaatgaataaaatctagtattttgtagcgtaatagggtaacaaaaattaataatttattatatattttacatacccaataagatgaaattggaatgtccctaacacaaagaaatgataaaggtctgaagtgatgaatactcaattactctgatttgattattacacatagtatatctgtatcaaaacatcataggtcccctctaaaaatatacaactattatgtacccataaaaatttaaattactttttaaaatattaatctatgtaaagggttttgaatagtagctgacctataatggtccctgaaatattagctgtcagaaacagcatagggatgattgtagctgaaagcttgctatggccctccaatatttatctttctgatatccagtaggcttcctagttaactctgcctgtcccacatgggcatctaaattcaccttcaggaagtcactattactcctaagactgttcatggagtcaaatgatgttccatagaagacaaaaccatcttgaagtttttgatgctgtcttgtttctgtcatatcagtaacactattgacaatacctgctattcactatcaaggaagcagaatacagtgctaaggggtgagaggacatgggctggctggtgttgatcaaagactttgaaatctgttttcagtgttttgaattgttgatacaggtaatgtatgaaaagggaaccatgtggtcagacagggtggctggctttctggaagttcagaataggaggaaggtgaaaaggatgagtgggcatggctcaggctgccatggagccatttcagaagtcctgagatggggacagtttgtatgtatatcagaggagagatcaacaagggagataggagtgttattggggagcacttgaacatgaaataagtgaaaggagagccccagggagatccaagggttgacactaacaggcatctaaaagaggttttccgaaagagaagcagaatcactggagtctaatcccagctctaactttgacttgcatgacagttttcctccctggacctttgtttttctcatttgtataatgagagcttgtgagttgggctgttttgactgtaatcaacagtaacacaactccaactagcctcagcaaaaacatataaaattatcagctcacatgattgaaaatttcacagtgtgagttggctttggaaacacttggatctagatgcattaatgatatcctcaatatcacccttcatcccccagctttgctttctataatattgatctcaatcttcactctcagagggtttccctccaagatggccaccagcaattccagtcttttattcttctagctaaaagagccagagcatctgttttcccagtgttccagcaaatatctcaaggctgaccgtccttggaccaacttggtttacgtgcttatccctaagccagttattatatccaagaaaattctgtacttctcttagccaggcctggggaaatggagatgaaattccctcaaggaaggaaatgatgctgggctggcaaaagtcagacagtccgttctaagggtattgtgctctgttgctaaggtcccattaagtactaacgtcttatgaccgcagactgtgccccaagcctgagaatttttagaacccagcatacacacaaatggaaatgttttttaggtggcaggggataaggacagccatcacaccaggtttcttgctggtgatgctggtgagcagattgcttaattaagactatcaaattctaagtgctgccatatggcctcactcttcaacctgttgagtgtcttcactcacttggttctggagctggtataaatctgtttcatttctgtttttctttaaggaattaagaatacaggaacatacggatgttacaggagcatctcctaatttaaggtattagaactacataaactgggctgctttaataagtaaggcatcaaaatataaattgggaaagattaagcatagctttaaataggctgagaaagcagaagttcttattattctgttacagatcaaatctacacacattctagtaatagaggtgccctctatttgttcttttcaccttaatgttgatggaaatttttttggcttgagagcaaaagggcaagaggtacaaatgcttgccagtcaaaatatccccaaggacttctgcatttgacaaaattcattctccttctggagatagaaatagggaatggaaaaggaaaagatgtatattgagtccctaccactcatttagccaactatagaagaaacactgaatgatcacctagtttttgccagaccctgtgctaagtataagggataaagctttgaatcagataaaaaatgtgcctcctgctgtggagctttgatgatatcagagagagaaaaaggcaaacatgatataataaacccttgagaacacaggaaaacggcacatgacaagacgatggttaagtatcatgaaggaaataaggcaaggtcatatgatagagatttctgcatggctgctgaagaatgggtggtcaaagaagatttttctaagaagccaagtcctaaactatgagaagaatccagtgaggtaaaaatcaatggtataaacacttaggctgagggagtaactcatgtcaaagccctaaaatgagagtgggttcttcagtttgagatactgtgatccaggaggagggctgtcatttgatacatttaatcatctcaaatgtcttgcaaataggattataaactctatgttatagataggggtataaagattgactaaagagcccaagatctcactaaaaagtgtcagtggtgttacaatcctctgactccaaaccccattatctttccatatggaatgctgtagctggtgttggagtcttctttcacagtaaagtgctcctgtcattgcctctgagaacagactggggtgtccttgatagtttcacaggacagtggtgtgggctcctaggttatattgcctgtctctgtcactcacaatgggtggtgtttttaagctacccaaacttccagctcctaatttttctcatctgtgaaatggagatagtatttcaaggattaaacaagatagcacatacaaaggagtgacagcagtgcctgctacatgcaatatttttattttaaaaagttggttggttttatcctttaaaagaataaggctggggtgggaaatctctgtgggatgatgctgtttgaatgggtagtgctggatgcccaccaaagatgacccacgaaattttcaatatagcttggctcctctgaaagagagcatattttcttcctacttcttctgagactctcttttaagtattttcatgttctagggatacttgttctcccccacccctgaccacttctcactcatgcttggtctctttgagctaaatgttaaaaacatactctatgaaaaatatttgagaaattagtactcccaattttaggtccagatgtgttctggaatttagaaagataataagatgcacacattgtattacacgattctacgagcggggtctcgggcagctccctgtattaaaacaggttggcatttcaatagtaaaacatatgaatgtttaccctcagtaggataaataaggaccacaaataacatcatgtcagttcaggttgggttttgctgccaaatgagttataaaaacatgtttggtatgctgagtctcttggatttcagaattgcagattgcagtccttagaacattcccgtgaaaagttgcaaaccttagtcgtgctaagatgttgagttggcgtcttcacatcccggccacttctgggagcagcagagtgtggtggctcagcccacccctcaacccctctactacttgtgaacaccttggtaaatgatgtcttggcaggccacccccgagaagtggccaagtgctgcaccagcttttttcttttccatttgaagccaaaacgattgtcagcgatccaggcttctcttaactgtgcctgtcagctgattctgaagacctcccagaggatctatttttagctaaaactggttttaaattttcatatgtatacattaaattccatagaggaaggggggattccaaatgaggaaacattgattctgaataacataaaagaaataagcagtgcttgaaaaacagttcaaaatatgagtcaaaacctcccaggaatatggttagcactgcatttttccatggaaggaagtctgttgaattgaaaacagaatgagagtaagtggggataaattatactaagaaagagactcagcatgaaattctaggtactgaagaggggaaggagaataagaatagggaggactgaacttagagggcagttgggattgccagatggatactcatggggatgtgtggccaggtaatcaaatcgcattgtccaaaagggacatggaggccatgggctaggaccaggcttttggccatactcaagagggagagagaagatacacctcccaaataaaggcctggagtctgcacatgacagctttgattatgcttccaaggttttgttcatttttggggcatgaccaaggtagttctagaatgagtgaggccaaagctgaaagtgtcacaaagtttttgcgtatgacaaaagttgcctgctttgcttttggatgctcaactcagacttcttgttttcatgatgtgcagttttgatcaggacattttagtgataggtatagcctacttctgtaccaaaggagaggttggattatctgttgaaaagcgttttgttggctataattacaatatgatgacttagttaggattctgataaatcctgactaactcaagactttaaagaaagatacttaattaaaatagaaggaagttgcatagtcacaggttcatccaaagacctgaatgacaaggtctcagaaaggacagaaactagagaagttccatgggcttaagcaatgggaactcatagaattaggacagtgcttttcaaacttttacagtgaatgacgatatttgtttcattttgttttgttttaatgtgtcacagtaacatacttttgttaaagaaaaatgtcaaatatagttttcaaaaagtttaaaacatgactcacattcatatctaaagtgaacacatcaaagattttatctatctcaacaatgcaaaaggggaccaataaaatgataagtatgattcaaagagcattcgagaaactagctatttgcatgcaatttaatagtaaaggagtgttagaataagtttgctaggttacatacgaagctggttaatgtcctgtattagtctgttttcacactgctgatacagacatacccgagactgggcaatttacaaaagaaaggtttattggacttacagttccacatgagtggggaggcctcacaatcatggtggaaggtaaaaagcatggaggagcaagttacgtcttacatggatggtggcaaaaagagaatttgtgcaggggaactcctctttttaaaatcatcagctctcatgagactcattcactatcacgagaacagtacaggaaagacccatctccataattcagtcacttcctaccggtccctcccatgacatgtaaatagtgggagttacaattcaagatgagatttgggtggggagacagctaaaccatatcatgtcctacaggacaaaaaactgtaacctctgtggttatcttttctacccatcattacttgtatctctgccagacagaaatctgtgaattaacatgtaatgttgttaagcctgaaaccatcattgagtagtgaatagtacattttcctagataattaaataatctttgaattgacaagttaatgcctgtatacgacattgaaagaacatgcaacccacatttttgtcttattttcaagttttgaaccttttttcttagtaatataatgaaaatcaagttttgtaaaattaaataaatccaaagacataaaaggtaagcttttaaaaaaatagatggaacaggtataacattactatgtcacattgctttcaacttctgtactcgtcatgggcccctaacaagaggttgggcattggtctgtggaccacacatttagtgttaagataggaataacttaactccaaataccttccagtttgggatgtctttattcaaattcctggtagagaagctgattggcctggcattgggtcaagagcccactttgtggtctagcagacaggtatcatgtttggaagcccattccctaaactagggactgtaaacaaacaaaaatcagaagcatccatacagttactgagtttggagaggtagcccaaacaaggggaggacttgggcagtgctgagctctgaccatagaaaaaaagtatctgggaactatctcaagcgtcatttaggctcccccatttcaagcatgcacccaaacagctcatatactatacagtaaatacaacttctcaaagtagaagataactggtgttaaaacaagactacatttatgagaactcacttccataagggcaaatactaccttaacagaatctcagcaacattccagaagatggaagtcagaatagatatttatagggcttgtagggagggtatagcctcaagcaatttaagataggaagatgattggtattgggtaaattcatgacatcttgatttaagattgttagacatagcaagatgagtttactgaaataagtctgacaagtaggttattgtttgatagatgagctatttatctagctaaggagactgttgtcccagataaattgatatgcatggattgtccaaatgaagcagtgaaattgttcctggtttagagccttatgtttcgtggacaaaggtttctgtgaacaattaagtcaggttgacgaaggtgatctcagttgttggtcttaagcactacgccatgttgatttaggtggtctgaattctcaggacatggtagttcacatttgttccatgttagcatttcccaaacttctgtctgtggaacactattctgcagagtggtaacagcaatgcaatggggggaaacatattttgaagttaagtaagtttgggaaattctgttttgttttttaatttaaactgtaggccctctcaagtctttatgatgtgaaaatgcacagtaaatattccagaaagcatgcaaaaataccccagaatctaactcctttccagtctgaagagctcctcaaatctctcctaaagttacttgctttacacacagccacctctattcatttttttttttttaaatttccagtagccagtgtaacctgggggccagggaagacctgaacctctaggactcaaaccctgtcatgattcttgaggagagaggaaggtggaaatacatacatacacatagacacacacacacacacacacacacacacacacacacatatacacacacacacactctatatatgtatatatattctcattctgctaaactaatcgaaagtaagatatagtaaaatgtttgaaaatacatatgtgcagctttgaaatgtcttcccatatcataatggctgtggaatcagcctcagaagccagattgtctgagccccaaggaaacgtcaaacccctctccctctccagtagcattccccagtctgtgtcacttagacgaaaaggatctcagggtgggtggcaatgctccttcactgaaatctgcagttatctctacccaaggcttacagtaaattttttgcaaattagaaagccctttgctctctcagtaaaccctggctttcaagatttttgttttagtaaagtctttagactaaatgttgaatctttcactctctttgctcctaatcatctctaagacagcaaatgcctctagcaaaaaagaggagacgtcaactgggaaaatttgaagagaaagtcacacagatacatttcagtaaggttgtctctgttacttgaggcttacaagaaggaaagaattccctctctaaacacactctaaacacacaggagttgagaacggggagatttattccagaaccccttctgtgcgttggggcttctggtagcttgcctttcttggtaacgattttctcagagactgggtagattcgagtggagcctggggcatggttgttggtccaatggcgggggttggggagacacaagcagttggcagggaacttacaaatctccaggaggttattgagaataaaaattcagatattgccatcttttccatttcaaagcaccaagagtctgtcatcagcaattgtgcctttctaggtgtcacctgaatatctaacattgaggcattgaaagatagatcaggactgattttactgagcattttcaaaggcagcaggcaggcttttcaatgctgcatgagatcctcaccttctctgaggtgacaggggcttctgttttcttgagtttccctgtttgctgatgtcatcccctcctaccccatgaccatgacaccaactacatccatgatgtatatttccaatgtgtttcaacttatggtcagctcccaccagctccatattctggtgggataagcaagccttgccttgagctttgcaggctgggcccatggttgtggacatcacagctctggtcctcatagtattggtggcaggcagatgcccagctctggcacctgaatgcttggatttggatgccagctctaatacttactagctctgtaacctagaaaaagctccttagcttctctgcactttaggtttcttttttaaggaacactgaaggaaaatctgaggctggtacagtctctgcttggcaaatggtggttatttctatccattaatgtcatctgatcatggcccctcaaacctcactttgagccttgtgagcaaatgatacatactgtttatatatatattttcctatatatgtagaaaaatatatattaaataaatataaaatatataatttaattaaatatatttaatatatatttatagtatattaatatttaatatatactatataatatatacatatattgtatattttatatacaatattatatattatatttatatgtaattgtatatttatacataatataaaatatctattatatgttacatatatttagatataatatattttacataaattataatatataataatataaccagtatgtttcattatatataatatatagatacatactgattatatatgagtatataacatatttacatgatatataatatataagtatataaaatatgaatatatattatataatttataaatatatataaattatgcaaattatatttgtgaatatataatagatttatctaaatatatgttatatttagctatagaaatatatattatatatttagatattatagaaatatataatatatattataacatcagtatgtatcattatatatagatccatacagattatatattaatatataatagattatattaatagatcatatataatcatataatggattaatagattatatatactatttatgtaatcagtatgtatatatattatttcaaacctcactttgagccatgtgagcaaatgatacatactgatcatacctactgatcagtgtatatttcagtctctttgtatcgccctatatattttccactttgcaatgagaggcctttgcttctcaagtgcagcgtcctcatgcttctcccacctgaacaaattattaaccctgtaaaccggctttcagcaagctacgtggatgaggggtctgaaggtttttagtttcttattagactgtctctcgtttcacttacatggtacccgctgggttgattgcttcatatatcggtggtactaatgtggatattgaatgtttcacctgccgagggccttcatctaattcatactgagcacatagaaaggtgatttgaatgggggcatttgctctgttattttggtgatggatttagggaaatggaaagtagcaaattgctttgtttttggacctttgccaggtccatcctggttatggataatacttgcttggttgattgaagaaggccagctgctactctaatagcccaagtcaatggccaacggtgcctgattagcaagcctgctatgcttactgtagtgaaaaacatcttataattataaattaataccctttctattatacatcaatatgctggtatatttcataagttggccagcccttcatgactaatattgatattaaggtcaactctagttttatgataccaaggcaaagaacatctttaagaaaatttagatacaactcctgactttgaatgagggaattcatactgagaacctcagtgttaccatttgtaaatcagattaaataatgcccaacatctggggctttgaaaaccaatgggataaactttgtgagaacaatttttaaagcctttagacattaccccgtggtgtctagtgtctcttcatattttcctctgggtttatcttgaccctttcaaatggaatgcgtggatgccattagtatttataacattcattttcagtgctttagtattgtttttttctttattgttgtgtaatatgtatggaaaaggcatatagcaaagggtgatcaatggctgggcttatcctaatctttgtgcatgtgcttgggtgtgtagaggcttccgttcgtgtctctgggccatcttgcataggggttcaagctcccatttggatgccatgggttgaagtctccggaaagctgacctcagatgaggattggtgtgtaggaagtttattagggagtattctgggggtcatctgctgtgggagggaggggaagaaagctggagtctgacagtcttatcaaaggctcagtcaatatcacagggactctgaagccaggatggctgttcacaatggtcctgagttggggcaagggagccaagcctgtataactccattacaatctgtttttggatgtgggctgtgggaaggagccatgaccttagaggaaaagactgtctttagccaaggtaacccatagaggactgacaggtgaaggctgtctgcagaacctgggaaacatagtccttccgtcctgaaaaggaatacaacaggcacattacagaattcactacagtcatctagaaaacaaagccatctggtatccatggagacagcttccatagtcactattgcccttggagacagacacccacattcctagtgtggttgcctgacagtggtgaggaggagggggctgactatctgagtgtccccctgcgatacgatagcatgtcacctggttcatgacccccacacccaggtctctttccagagctcacccctttttgaggctggcaccaccctggacccaccaccagcttctgtggcagtgcttactctgctgtttaacctgcagtactaattcctgtctttcaagaactctgtctttcaagttccccattattaactttaatgtatgattatttatgtgtatctattcatgcatctatgtttttattaatttaggtatgagtgagtcctcagctcagtctgattcacatcagagcttttttaaaaaaataaatatcaggaatttttagagcatgtaaattatgattcaattcacacttgtctttttatgagttactgccatggtgtgaataaagcacacaagtgtcacaaagatattaacataataataagcattaatctccactagtagagtgttactaggcagggttccttccagctgccatatcaggaatccttccagcctgggtactaatgtcatcttcctttggagaccaggcatgaagagtcactcacttcctgaagtcactgggactgaaatccaggcagtctggctctagtctccaactccgctgccaatgaccaccagcattgcaaacccgtacacatgcgtatcaggcagacctggccgctggcaggcaagctaaccagctgtgaaccatggtcaccgctgcagggtagggctcgatgatcagaatgtgttccttcatttcttaaccatgctggaaaaagtatgtagagggactaagggtgtttttattttctttggcttttttccttccttccctcccttcctatcacccttccttctttccgttctccctttttccctctctctctccctttcttccttccttttagaaaaaacaaacctaacagtatgtatgtctaatacatacaaaatctggtatttaattttaaaaatttattcatacgcttggtaagatttttaccaagccatttggttttttattcactctctctgatgtggatcatgcctattctccttcttgggatattaggagaaaaaaaggatactatgattttcttaaaatggagctgtttaaatgaaggaagcatgtataagcctacccctttaatgggagggttcaataaatcctagaatttgcctgtaatgtgtagaggtctaaagagatttgtcctatgagaaagttcactaatttcaattatctgggttttattatcaccttctaagggttagagagacaggattttatagaatgccatcacctgaggctgtgacaatggggtttcacaccattaaattcagaaagcataagagaagagataagaaatgagagggcttgaagtgcatgccagttccgttgtggaaaatatgacctactaagcagctatgagaaatgaaagcaggcagtgtcatctcatgatctattgctattgtatgtgaaatgctttctatattagctgttgttaattaccatcatccccaccatcacatcattgtatttaatagcaggagaaaggaagcagctgttgtaggcaaagctctcacacttgagtgtctatcagagtcacctgggggaacgtgtgcaaatgcagattgccaggccctttgcctagtggttcacaatgagtatgatcaggctggaacacaggaatctgcatgttttccatcgactatctcagctgattctgattcaggtggtatgaggattacactgaaatagcaaacccatgctttgtctcctgttagtctagacagtaggcatctttctgttacctcttgggtgtaatgtttagtttaaatttcagttcctcatctctacgagggagtcataaatttgcatcttgctcacagagctgctgtgaggattagctgagctcgtgcccagaatggagcagcctctaatatttgctgtgctgtctctagagagcaacagggaggcatttcatggtcttccccatcttggtcctcactgtatctttctgtccttactctgtgcctgggacagctttagggcttaatgaacataacagaatgctgaagagctcagccactggagcccagctgcttggatgcaaatcttggctctccaacttaatgcctgttcatgagcaagttatttaacctcctagtacctcagtttcctcctctgtaaaatgggcttgattatcatacccccatcataggtgtttttttttgggtgtatgagatgaattattatgactacaacacttaaaaccaataatgaagtgccatgtagatgttcattaggtgaataaatacaaatattgttgattgaatgcatgtctgcatgcacgctgtttctttccttatgctgtttctttccaacataatacagatgtattctactagctgacagacttttaaagtagaggccacttttaaaagcctgggctcccatgagaaggaaatctgcaggtataagatgggtttgtcagtcagcagaggcatgctattgagaaaaggaggcaacctggggagggggtgttagaagagagcttgggattcagttcttctaaccaggagagctgacaagtaacaaaatgagactccttctgttgtctgttgcagtagacaaagcaagatgcttagttaacagcagcaacccagtgcctgtaattttcaagtccttggaggcacaccatgtcacccaaggtaagccaggggacacaggagggaagcaagagaagccagggagaatctatttcctgtgtcccctgtaggtgtttgactcacctaaagttaacactaatagaacatttgctcagaaatgtcatcgctgaaataaacgtgttaaatttaaacttgactgccccaattcatctgttatgcaattgaactggaaacagctcagacttaaaaggcatctccaagtttttctcagccaacaagacttaggccactttgttttctcagatttttcagccttgtccaatttttggataaaaatcctttttgaaaacttcagcagccatattattttcttctccagtcatcaacttataacgtaaagacaaagctgtggggaaaatctaaagttgcgtcaaatttttattttctagccagctacagctctagtctaaagctctttcttttggggagaaaatcccatttgcacatttcctcttagttgggtggacttacccatatatacttgggtgacattcaggaggctactttgtgttttggctgtgtattctaatttttcttccggtactatatacagcaagagaaggggatgttgttcagctcttgttctacctagaacccaactgcacttttgcaagagatggatacaaagatggatgcataatgcatgatagtatattatgagcactactcttatggctttgcattgtaagtaattttaatgtaaaacatatttctatagtctggttacaaaaacaaaacattttagaaaatttggtcattctcctgaaaacagcaaaaagaagaaaaaaaatcataaaagatctgctgaaaaataatcagttttatgttttttctttcatgacagcttcatccatctatccacctatccattcttgtagctctccatccacccacccatctatatacacctcccacccccccacccactcattcattcatccacctacccatccatccatccacccatccatccatccatccacccatccatctatccattcatccatccatccatccatccatccagccatccatccattcacttatcctgccttgcatcctaccttctatccatctgtccttctaccttttcttctatctatctgtatattctttaatctatccatccattcatcctgggaagaaataatagtatctttaaaatgtagtgcattggttacaagcacaagatcttcagtgaatcattttgtgcattcaaattctgtctgtatgtatcatgcactttctatgtaaccttgggcacgtttttatgcttctatggccttttcagtctttaaaaaatggggttaataatagtgcctacctcatagggttatgtcaggatttaatgatataatccatataagatacttgacaaagtgcctggcatagaggaagttctcagtaaatattagctgtctttatcattattatcctcttgctaacttaacagagttttcaagatctggtgagaaaacatgtaaaagatacataatataatgtctattaaaattataattataaatgcagtcataaatatacacatgtatatttcatttatgttactgatatccatctgtttcatcagctcattttaaaggtttctttaatagctgaaaaatattctgtagtacaaatatttataatcaaactgttatagctattcatttagactatatcaaatttctgttgttattaataatgctgcagtgaacatccttattcagttatttccttagattaagttttcagaagtgaaattggtggttacagagtgtacacattgcaaagctgaatcatattgccacagtgcctggtgtttgcatttccatatggttttgatggccaggttttctgcactattgccagtgtatgtgttatcactgcaaacgtttgccatttcggtagacaaacatgggatgttattgctattttattaacttgtttttatttgatcaccagcaaagttaaactttgccatgtgttttttgaccatattcatttctgtttcttaaaattatcaacttagaatatttgtgcaattttttttttttacatgtggagcttgttcttaatgattctgccagggcttaaaatttttactttctaatgagaaagttttggaatttactcttttccaatttatgaaaattggacaccggctccatgcactgttctaagcctttttctgtgttctctgtgattccttagagcttactaactgtgaccctccagtcaaaaccatgtttaaccaagtgctgatgggcttgagtccattcccaagtgactcggaagttgcttacttccctacctttgagtgggtctcattttatctccgtgatgttttccttgtccttctaagtcatattcactctgctcattgaagaaaaatggttggtaattgtagtggataactactccattctgtatgccttctatgtcttttcttgatgtgtgcacctctttctttatccttatttttaaacttgtgcttattagataggtttctgtacaaccatatctgtgtaggtttctcaccctagaagcctccttttaaatagggcaaagaagctacctaaagatttctctttaatatagggaggaaaccactttcgaacttgtgcccaaagatttatcttcaccaatggtctaggacagaggtcggaaaacttttactgtaaagggccaaataatacatactttcagctttgcaggccagctggcctgtgttgtgactactacacaaaagtagtaagagtctaatttggcccaggagtttgctgattcctggtctaaatgagagtaaagaatgggaaagggaatggtgtgggaggaataggcattttcattcattgttgttaatgagaaagagtcttcaaacaccagcatgcccctgtgggttggattaggttagaaaatccttggaggactgccttttccaccccagagtcctggagagaagaatgcagcctgacaggaaggatctgggtaggtgacatgtggggagaggattaaaagaaaggagggccagtggctcacgcctgtaatcccagcgctttgggaggccaaggtgggcagatcacgtgaggtcaggagttcgagacgagtctggccaacgtggtgaaacctcatctctattaaaaatacaaaaattagctgggcgtggtggtgcacacctgtagtcccagctactctggagtctgaggcaggagaattgcttgaaccctgcggatgagaggttgcagtgatctgagctcgcaccactgcactctagcctgggtaacagagtgagactccgtctcagaaaaaaaaagaaaggagaagagtgtctcaagggtttttttttccagcaggtgaacccagcctccctagcaacccaaggttaagaacgtgttgaaaacagcatggaagcccattctggaaagcagtggtgattgtgattctgaacttaaacagcttcccttaaacacactgttacttcagaaaagtacggttttggccaaagggctgtatgtcaggtatttacttgctcatcttggtgggttttgtttgtttttgtctttttggttagccatctaagacattatttttctgagatccaagttccaaaaagcaccgaacaaccttttgggaagaaaacatacatagtgtgtaggtgctaccgatttgtatcctctatgaccttgccatagaaaggcaaatcagacgggcgctcccattgcctcattgcaggctgccattttcatataagcttcatgaaatctgggagaataaaggcaaaaggtttgatctggctgtgacagggaatattgtgaagctgctggactgggcctgtgggttgcctgtgactgtcatcaagttcttcttctctggaggcttcaaattcctcctctgtcaaatgaagggactggactagaaacagaatggcaagtacagggcaaatgccccagtgctctctgtccctgctgcctctggcagccacttctgctcccccacagcatctcctggtcgcctggacagaaagcctcctccatgcagcactgctccaggaactgttctcagccattaaagcagggttcagaaaagcttggaggaagatggccttgtagacctcccctagcactgaagttctgtgatgcttagcatatgtgaaactcaagtttcttctgttcctgaatggggattatttattgccttggacagcagccctgaaacttgatccatttagctgcccctaagtgtagttaagccccgtgaaatgtaaacttcgcaagtaaatggaccattgccatttgcctctgtcttctagatgcaattgttttctatagtctgtcttgtggccggttataaaatgtctgtcttgagcaagctggggaggagggtggatagctttcgatttgcccaagtttgttaatgtttcattgcttggggtgttttaagatcctgtgcctttaatagatttcctgaactaacagtttgccttatttacttccctgggctataatcattattgtggctgaccatgttgataagctactctgtgaagccttctctaatgaatgagagtcactcttcaagtggttattccccttaaccttattttcaatcacagaaaatcattctcacagaaagtattctttccttttgttcaaaaaatacccccttgaatgttttaaatgtcactgttttttcagttctaaataatttttaattggtttttacatgaagttaactgtagcactcttgattcaggaaaattgtgcttgtctgtctctctattatctctctctctctctctctctctacctacctacctatctaccaaccaaccaacctatctaaaatctatctataatctattagtttttcttgcttcacaaatgacttaaggcaactcgctttcgggttgatggaagaaaaaatacaagtagcaaacttggatgaagttggaagaaacttggcacccactgtgtctggcatgtgcagatatgagtgatggtctataaatttaggatcttattaacagccaaagcaaagagtacaatttttccatgtatctggtttatagtatccacaggatacaagcatgctggttgatcaaatgttgcatctatatctttgtgattaacacctgacagatatttctatgatgcgttctgacagggttacacatgacagagttggctctgtctatgttgtacttaatattattgtagaaagaaaaattgagtatatcttgtgaaaaatagttccatttgaaagtccatttctttcaaattcaaagaaagaaaacaactaaaatacgtaagtctaaagggcatggttgatttaggattttcgagtgggaagactattaaaagagatgcttgctcaagagagtatagactcttctttggaaattggcatgggccacagacctccataggtaatacatttaaaacacaaatgctttttggggtactgtctcccagtactttgtttttgaagatttgtgactacatggtttcagtgctatatctaataaaactggcttcaaaacgcagagcactagcattttcatatgtttcagtaagtctcccagccttcgtgattctagagacaccaatcagttgatgctagctgcagttgctagagattccttcctggaattttgatgtaggcttgtaaggagggaccatacttaacatggaaaattaatgacctgagagcctgtcccaaaagaaatgctccaggcaggagatcttcaacaatagccatctagagtttcagttatctaggatagaacagtgtataggctggaaagacccagccctttcagtaaggcatgtgagtttgatcactcaccaccatctccagcctcagccttcttggaaggccccagacttaatggtcatttccaaccctctttaaaaacgattcctttgctagagtcggaataaataattgaggcaggcttctccagaatctcattggtgtcagctatggagtcatcaacagatgaaattattccatcaggatagtaaattaaatggcagtcttagagtggagttttcaaggtcttcttacatttgtaacatttgttgtcctacatagtcttcatacaaactataaattgagcatgagagacattctttttttttttttttttccaagactaacttttgctctgtagcccaggctagagtgcaatggcatgatcttggctcactgcaacctccgcctcccaggttcaagcaattatcctgcctcagcctcccgaatagctgagattatatgcatgcaccaccacgcccagctaatttttgtatctttagtggagacagcattttaccgtgttggccaggctggtcttgaactcctgacctccagtgatctgcccaccgcagcctcccaaagtgctgggattacaggcgtgagccactgtgcctggccggcagcaattcttttatatacttggagggtaggcacttgaagcccagaaaggctaaaagactaggacattaagtcatagaggagggtttttttttttttttttaagttttgttgttggtcgtgatggtgttattcaattcttttattatctcagaactcatgtcatactgccccagcctctgtatcagcattatgtagcaatgatgttactgagcctgatctctgtaagaggctctgaataaaatgagttccatgctggaacttatgtggagaatctatgttctgtatctctcccttggggactcttaatttcctgggtagtgaagaggtcctctaagaaagaagcagatttcgtggaacccaggatttcccatcctctttttatctgcactgcattttaggagcttttaaatttctgttctggagttgggcatctcttcaaggttaagactcaagggctgtttgtattcctcttggatttgcctacatttagcaaagcagaaactcaacacattgttgaaaatactgaatttcactgggcatatattttgggttgtctggaagatcccacctattgagtacactgcaccatcacccctccaactgctcatgcacttatcggacatatgttgttatttttggatcagaaaataccatcccagtagaagtaggagtgatcagtgtgacagagagctgtctgtattgcggctgtaaatgccagtgaccatggcattgagcagaccataggttatacttactgtcgtggttctcacctaaagtacacatcacactttgggtttccataggaccaggcaacataatgacccacctgaagatgaaatgattttgaaataccaggcccttatcatgggctagggacagtgtggacattcatatatgtgaatgctccttaaagcttccctataaccttggatactgctggtcacgtgtcccttaaatatagatgaggaaattacagctctgagacaattgttgttggtcagtatccttttgatcctttgtttgtaaatcttgcccagttggggctgcatgaggttgaaagctcagactgcttcacttccaacctcagctcgtccctttatgaagggaggcagctcaactgcctcccttccaacctcagctcatccctttatgagctcatagccttgggcaaattacttaacctgttggtgttcagtttcctcatatgtgaaatgaaaatgatggtatcatttcctcctaatgctgacttgaggattaaatgagttaacacacataacgcttaggatggtggtggacgtacaaaacactcaataagaatttgcttttgttattattacttgttcacatctatgcagcatttgtgcctgcatgctcacacactctagtcttacgcagcttattcaccaacattggttcgggatgacatttgactgttttcaaaagtcaaatccacttttcatggacaaagattttccttcataagtgttattcaaaagattgtgctgtctgccctgaaaacagttcttatggaggagaccaaaagtatttttggtaaatgacagtctgtgtagagtgagtcatgtcactagatgtgtacttggaagggcaaaacagttatttcaatgtacaaattattgcctcattactttatcacataccagaagagagtttgggatggatctaagaagtataacaaaaccactgcaagttgttctgtcatttagcatttaattaaaaataactagagaaacaactatttgaaatgctcagtgtttttcttctttttttttcatgtaacaatatgtttagtgaatttttcaaattactaaaagcattcaggcagttctagaaatttgcatcttgtaaccctttagttgtttttatttagaatgttggcattttacagtagtgtcaagtatggtaattatttttcatagatattgaatttaaaagagtaatccctaaacacattttgacatttggctctccaagacaaagtttgtaaaaaaattgtgacctgtgaacggtaactttactatatacttgtttgaccattatctaagaaatatgcctttaatgaataagagggaaaaagatgaggtcagacatcaaagtccctgtaattctaatgtgaacaaccatgattcctgaattccatgtaaattagcactacagaatgaaagcaaacaaacaagcaaacctcaaacagagaaacctcaaaattactagagccaattagatattcaaaggaaaagtctcagtttttaataccttataaaatcacacaaatacatacacatatgtgttggcatcagcagttttgatagacatggcttaaaataggagaaatccaaaaatagataaaggcacttttaatatggcctaagccatagcaggaagtattaataacatgccgattttttactccaaaaagaactgagtgtgcaaagcaaaccaagaaagaaatgtggactgggccaactaatgggtttctaatcattgttaatctacaagtgtgatcagtttattataaagtgttaatttttcctgtgggtaatacttggagaaatacagtataccactcatttccaaagtgatgaaatggctttctgtttggcatgcaggaaagtgaacctctttagtttagaatatgggttggatatgcttgccaggtctgggctattccctgctgcctctgagcgaaagctcaggaagccagaacctgaatctcttcgaggaagttctacagctgacttttaatcattgggccatagcacaacacctattagctcgcttacgtctaggtcagtagaacctcctctggacctcagctactcttcccactctgcatctcgagacacttgccttctttccatgtgacttatcgctaagctcctgactgcatgaacctccttccttccactggtccaagtgacatcattcccccgtcctcactcccaataccaccacttcagtaacctcccacatgttttcctgctctactttaatccagtctacacagagagagcagccagccactatcctgttttatttatttatttttttacttccttaacagacgtttactggatatgtcctgaatcccagtcactgtgttaggaagtagctcaatccgttgtctgtacacctccatgcatccgttccttcattcaatgatgagtacataggacaggccagttttgttctccaggctggtctcgaactcctgggctcaagcaatccacctgtcttggccttccaaagagatgagattacaggtgtgagccactctgcccagctccagggcaggattaaaggattgttctcccatgttggaagaaaacagagttcaggccccaaggcaactgacattttactgggccagacagtgccttaacaataatagggcaggcgtggtggctcaagcctgtaatcccagcactttgagaggctgaggcgagtggatcacctgaagtcaagagttcgagaccagcctggccaaaatggtgaaacgtcatctctactaataatacaaaaattagccaggcatggtggcgtgcacctgtaaccccagctacttgggaggctgaggcaagagaatcgcttgaacccaggagacagaggttgcagtgagccaagattgtgccactgcactccagcctgggcaacacagcaaaacctccatctcaaaaaaagagaaaaagaaaacaataatataattcaggtagtgaaaacatcccagaaaaaaataaaataaaatagagacgatgggaagtaatgggaaggctgtagctagcatggccacggcaggccttcccagcagggcatttgagggagacagaaataaaatgagaggcaagtgacgtgaatatgtgtgagtgtgctctaaccagagaggaagactatggcgaaggccttggtgagtctgagaaatgccaagaaggaaggccaggctagggagtcgtgagcaaggtggcggatgggaaaggtggggacacagaggtagggaagggggatgatcttgtggggccttttatgccacggtaaggaggttggattgtatcagccatgatgttttccttcttcctgtcaaggtgaaatttatatgacgtagaatcactcattttaaggtgaacaattcagtggcatttagcgtatttgcagtgctttgcaatcaccacctctacctagttcaaaacattttcatcaccccaaaaggagagctcatactcattaagcagccgttctgcattcctctacctccagcccttgacatccaccaatactactttctgtctctaaaaatttaccttttttgatattaagaagaaaagacacccacacatatactcaattgtgtccttccctggcttgttaccctccctccttcatcacacttaggctcaaacacaaatttgccaccatcccctcatcatctggtccttttccatttctttagtctaacttcctgctagtcttttcttcactctttaagagtaaaggcccagactcactggttctcctcaagtggtgtgtttgttacaattgatgaacccacattgacacacaattaccaaccaaagatgccatgctttatatcagggttcactcttaatattatgcgctgtatgggttgggataaatgacatgcattcaccatcatagaaactttgaattatgtgaggtagtagatgatgaaacaaacattacatactaggaaagggacgcctctccctttttttttttttaaagaggggtgttttctgcttggttttgtccattataaactgttagattaaccatttgtacagccaatgaaatagctttaagggaggcactcaggagcttgaacacgtccacagaaattccaaggtctctccagtatcaacttgcagtacgtcaagccagtacacatgggagagccttgaaggggtacaagatcagcctcccctctgctctttgaacacactgagcttgtggctgcctcaaagccttcgcaggcattatccctcttgcaaattttttcatgggtagtgcttcctgtcattcagttctcagatcaaacactacctctttaagagctcttcactgcctactttaaggcatcaccctgttttatgttgtttatataatatttcacaacctgacattctctcattcattcattcgtatcttacctgtttccctgtagaagtataggcttcatggtgagcaatagccttattttccttgttaacgggtgtatttccagcacttcttacaacactgccaggcatattgcagattgagatagtctgagtcttctgagaactaggattaggatttttttttttttttttttttttttttttttttgaaacaaggtcttcctctgtctcccaggctggagtgcagtggcgctatcacagcttattgcagtcttggcctcctggactcaagtaatcctcccacctctcatcctcctgagaagctgggactacaggggttccccactatgcctgggtaatttttgtattttttttttagagattgggttttgccatgttgttcaggctggtctcaaactcctgggctcaagcaatccgcctgccttggccttccaaagagatgggattacaggtgtgagccaaggtgcccagctccaggacaggattaaagtgtgaaaaaattattaggggatatacctgggagatcaaatgaggtgggagttgggagactggaagagctgtcagaccagatgcaggtctgactctcagtgaataagagacgaaagaaagaaagattgagtggaattattttagactgctgtgcaattcttttttttttttttttttttttttttttgagacggagtctcactttgtcacccaggctggagtgtagtggtgcagtctcggctcactgcaagctccgcctcccaggttcacagcattctcctgcctcagcctccccagtcgctgggactacaggtgcccgccatcacgcccagctaatttttttgtatttttagtagagatggggtttcatcatgttagccaggatggtctcagtatcctgacctcgtgatttcctgcctcggcctcccaaagtgctgggattacaggcatgagccaccgtgccctgccacactgctgtgcaattctaaagaattctgggagtgctgtcagagagtacttgagccaaagttgcccatcaaaaaagttttaaattcacaggagtgggtttgccttagcatagcttttgaactaagtaactggccagcagcagcatgtggaagcatgaccttggcaagaaatgtggccacagatatcagcacacagcagctggggtagctgatcaatgtacttccttcaatgagagatctgtgaggtgcatttccatggccaccacagagatgtataagaaatattagttcaatgaatgaataatgaataaatgaatgaatgaaagaattactccttcatgttatgtttataactggctcttcctccaggttttctgcctcacttttggctctctcagctactttattactgagaatttatctgtactgtctagttttacagcaacgctgggagctgctattatccatccccattttatagatgaggaaaataagcctccagataggttatgcaacttactcaaccaagctcaacaactaataaatgactcagctctgtcttctgaagttgacacttaaagcccatacccttagctattaatgctgtacattgccaatgcaaggtggataaagacgtggagaaatactctgccctgctgagtagagtcctgaaactgcaaggggtggggaaatagcaatgaatcctaggcttaggccaggtaactaagatgtgcctttatgagtttatcttgatcatttctttattcattcatttatcattggccatttattcattgttcactagtcggcaaacatttatcaaactcctttgcatgccagtccatggactaagtgttaatctttatgcctctgatgcttatcatctgcaccgtccaatacagtaagccacgtggagctattgagcacttgaaatacagttggcctcaattgagatgtgttgtgaatataaaacatatacagttctcaaagagtgaataaagaaaaaattatttttaaaatctcatgaatagtttttatactgattacatattaaaatgatagtttttggtcatataatgttaaacgaaacatattgttaaaattaattccacccatttctttttataattattaaggtgacattagacaattaaaaatgaacatggccgggcgtggtggctcattccagtaatctcagcattttgggaggccaaggtgggtggatcacccgagatcaggagtctgagaccagcctggccaacatcgtgaaaccccgtctctactaaaaatacaaaagttagccgggcatgctggcatgtgcctgtaattccggctactcaggaggtggagacaggagaattacttgaacctgggaggcagaggttgcagtgagccaagatctcgccactgccctacagcttgggagacagattgagactccatctcaaaaaaatgaacatatggttcctattataattctcttgaattatagcactggtctcatggatgatatagatagtggtctaaaagtccagaggtttctgaggtcacagagcccggagcaaatgtctgtggggaatgtttacagaggtgggagatttcacctgggccttgatgagagcactagattttacctgatggatgaagcagggaatggtcttcccagtgaatgatggaagggtggagtagtggagagaaaagcttcatccagttatttggggctggaattctaagtgaagttgtctcaagttgggttttctaggaaacagagtctgagctgcagtttagcatttttatttattaaagtgcttgtttattaaagagtatgcttaacttcactcagtatgtagatatgggcttccctggaaggggcaaaaccttggatgaggcagctctctgcagctgaggtaattcccaagaggaccagcattcagactgtcccccaagatcacactcatcaactaggatgacaagtcctttttgaaggaccatctgaagggtccatcacagtgtccacttcagttgtctagagaaatagagggcacagtgtgccttcctttactgcaagctcagtccacagggtctcacattagctgagtgtgtgggaggaagaccaagtgtctgtgatgtcaggtgggtatttcggagtgtatataaattacagtaagggcagtgtcaaatgagtatgtgtaatgcatctacccatggtccctagagtccactagaagacaatttcttggtgtttaagagattattcttttaataattcattgatcttaacaatacaatacatcaatggtttacgcaaaagccatgttttatctgcaatgcacttctaaattgaaaggtatcataaaatggcacttaactttcagaatccttatgttatctaaagctcagtttcagatttgtttgatgataacgaatatcctgtctattttattatctagtacaagccctagtttcggaactcagaaataaatgaggcaatgcctgcaggtgggtggcacgtgtaggtgcctgtgtgtgtgtgtgtgtttgcgtgttttggagtatgcatggatttggccttatagtttattgagagcatttttgcactggtttatagtcatgcagtgaagcacctctgcatttctcacctggcccatttagtgtggacacattcctttgtcaacaaggacataaagccacaatctcctcctccaaacaaaacaaagtgaatcgctatgtgttcggtataatgggattgagaagtagagttctctttgctgttatttctccataataggcccatgatttcctggcccctggcattcaggatagtgagcatgtgcaagtgattacgagggcagagcagttgccagttttccctgtagctttcagaatgtcatcagaaatctacacgtatgggcagtgaggtctggctctcccatgtctcccctgccccatcttgattgctctctctctctcttgctttctatttcccagaaacatgaacttactttgacttttccaaatataccatgttccttaccacccagtgtccttgcagctgccattccctctgccaagagtgattcttgctgggccccttttagatcacatctttattcctggtggacagaaagaaccaggacaacaagcccatgcctgtcccaagtatagctgagtgcttgacacttagagaatgtgaataagtgaatgagcacagcataaatgaaataccacaaacaggccaagccaaataaactctgaagttgagttttacttggttattaatgatctttggcacaagagtttcagtgacttgataaggccacaagccaagtgtggcctggttcaagaagtacagggatgatacagacaagacagaaaggaaataaattctatcaaaaagctcagctgtcttgaaaaagcaagagataagaaataacttcagaggtgggtagaattgagaaaaggatttctattttgttattttccccgaataaataagccttaaacatgtttgtaagctgctgtgaagtaaccagcagagaggaagtgattgaagatgagagagagaaacagagtaattgatgaaccaacgtccccgaggagacgggagggatgaaatcaagagtataggtcaagaggcgagcctgggagaggccagtgctaaggcaggtgatatttctgcccggccgttagcttttgtgcagaatagtgaaggaagaatcaatcacttcctttctggctgggtaaatgccaagaaattctatggcagaaacttccccaggcaggagactcagaattaattgttaggattaagcataaaccaaaacgagcagggaaatcccaagcactaaatcccaggaatggggccttcatggataaaggaacttcatctgtgaatgatccaggagcccagaatgccaagggaagtttctaggttcttggagatcaagttaatgcccctcataaggttgtttcacatgagccaaaatgtatattgattttttttttttttttgcctttattacacttccagaaagagagcatgatctcctggaatctgtttagggaataaaaatgtccgtacagaagaaaaaggttgttttttgaccttctgctgacactgtcttcttgctctcatcacagcttattttctagcaatatgaggcccacaaattaggaatctccttgcaggccttcaaatatgatttacctgattaataaaatcttagtggaatagatagtattctcctgtgtgtgtgtgtgtgtgtgtgtgtgtgtgtgtgtgtgtgtgtctgatgattggggttcttggatacttagggtgcagggatgagggcaagctgaccttgtttttcatctaggagacctgacaaagatggtgggctgagatagccgtgtaaagctaaaacagaaatacttagtgaacaagcaagtgtgtgagtgaatagatcaaagaatgaatgaaactaccctctgcactctaggttctagaaggcaccctgaaaaaggcatgttgcttggggtataataattgctcaatatatttttcagtaaggaataaaagaaccaacaaatattgattggattaaatggattaataactgataaacacttacagggctgcggcatgtgctaggtataatgtattacatagataaaatggatacgaaccatataccaggccctgtgccaattgcctgcatgtaactcaaaacaaaagacaaaggtcttgccctcatggagcctgaagtccagtgagggtttcgttaaacttgtaggacaccatttccatgccttccatcagtagagcagattctctgtgcagatacttttcacacaaacaatgcctaaccatcccagaaaatctgagcggtgttagcaacctcactttctctgagataaagctgagatttcttttagtgacttgtccaaggtcacatagctattacgtggcagagtcaagactcaaacacaagtctgtctcatttcaaaacttgggctgtttgcctatatcaaactgcctttaatttgcccattttaaagcaggaaagaactaaaaggcttgctttgatggatgtgaggtgatttgttaaaagcttaagagactgccatttttcatgatatgcgtaaatgtgccctaacctcctgaagcaatataaagtggttctttatgttcttagggtattccccatctaaggtaaaaattatcaaaactactggggagaaagcttctctggagatttgccttataaaataaacagaaatcaattttgacttgttttctaatcatgataaatgaagccaggttaggagaaaaaaaaaaaaaagtcccagcattagttgaggatcattttgccaggatacattggtctttgacaagcaattaagaagtcctgtgattgtgcctggcagtgccacagctcagcacactcctgattaattctcattttctttctttcctcgggatttatttactcgtttcacttggaatgtgtttagcttcttaacctcccccacccctcttttctcacgtgcttctttgcttggccccctacaactctacctatacattaatcagtgtcatattcattactgctggtgaaatgccatacaacattggcattcattcatttttgtctcttctgttgagccattcatggtagatttccccaacgaaacctaccatgtttgttttctgtatttcccaccagatgttcttttaaaagccagaagatgtctgccttggtctggttggtataaagagggttcatccaatataaactgccaacagtaggttggaaatactcatcagtatggaaagggcgaagtctgggcaaattggatgggtcttggagaagctctaagagttggaatctacatcatcatctttgtcttcatggctagcaactgttgactcctttctctagttcaggcattctgtctgactcttacattatttctttgaatccttacaacaactctataaagatggtaatggaaaaagacaagatgaccaagattcagagactttaaagcacatgagcagtaagtggtgaaaccacctcaggcctctgcctgttgacttattcataggataacccacagaaacactaattcaaacatggtgtcagaaacagcagcagtaatgaatgcctcaatgaaaaacatttggcccagcaccttggttaggttgagtttgcatggcaaccctattgaatcatgggtttctcagagctgggagctgcaccatgccatctacctgcacctgtcctctttggaggctgggttggtgtttgaccctgtgaagagctttggattgctttgcctacccgcagtggacttgctcacacataagtgggagccctagctcatggtctccaaatttttatcctcatcgtttcttcccacctagttttttcctaattctggcccttcctggccacccaccctgccattatctttctctgacgcttaggacttgaacccttttttcatcctttttgttttattctggtgttttagtcgtgagctaactggaaaatgcttctcacagtttaattgccgtggaaactttctacttggaatcagaccctaacgggttttttccctttccttagggggctgtgcatataggaaaagggaacatatatgttatccctcatgtgttaggggctgtatagtaacaagcctggaataacccttagagcaccttcatagggaaggtagggtttattatccatgtttcgtaaataagagcactgaggttgagagaggtgatgcagattgctgaagtgcctatagctaggaagtggcaagtcacaatggggccccagttctgtctgctctaaagcccagtctgtctgtctgcttctctgtatgtctctctttttctctctccctattcttctggaagtcatagaatcctgtgattctcttccaaactgcttttttttctattaaaattataacccgttattaaaatatttaagcacacaaattaactggtgctaattatgatattttgaatggtaataagcaattagagtgagatttaaagaagaaaaaaacacctgtatataacttggcatcttttgtaataaatacaaacacctaaatataacttggcatcttttgtaataaatacaaacttttgtcaatcatgacttgatctaaccgatatgcctcaggtctgcacagaacggaaatgttttttggaaatcctagtacttcagaaggctttggcatccaaatccattgcaagtagctttctatttagtctctcattttctctctaaagagagattgatatgatgatttttagcttaatttgagagatgttgagttttctccaagacaccctcgttggttcaccttgctctgaatcctttgtcttctcaccctttgtggcaaattgagacgggggaaaactattaggttggggcgaaagtaatttctgtttctgccattacttttgccccaacctaatacctcccagcaaaatgcaggggttgcggagagaaagggagtgatgtatggagagtcagtcatagtacatgtgcaattcaagatacctgggtgggcatagtagtctttcccctggagttctatgtcattgcagcctcctctcccatcacagcataatttaagtgaagcaggtttaacgggtggtcagtatttaccagagccagccttctgcttctggccagctgggtgacttgactagcagaccattactccatgtgggccaccgtttcccatgaatagagtgcgacatttgaactaaatgaacctaggtttgtcccatggagtgcagtttctccctaaatgaacctaggtttctcccatggagtgcagtttctccctaaatgaacccaggtttctcccatggagtgcagtttctccctaaatgaacccaggtttcttcaaaattctagaggctctgactctagcagctgcaattggactcttccctagaagcatctcgctgagtctgagaaaggcacgtcaatgattcttcaagggaagtagggggaagcagaggcagtgccattcacaatgagccacggctgctgacagcagttctgtaaccatccggtgtgtttagacgggagaaagagcttgagaatcgcgattatatggatcatctctctctagatggacttcttttatgggagataatactgaggttaagaggttaagcaacttgctcaggtcacgcagcaatttataatataacaagatatttatgagtaaaacatatatgaactaattatatatctgatagtcgtttttaaggaggaagaagttaccataagaaaaagaaaaacaggacttgggtgttataccatgaatcacacgtgtgtgtgtgtgtgtgtgtgtgtgtgtgtgtgtgtaagataattttttcagcaaattaaaaacaaagcctaagaaaaatgagaacttcctgaacaaaaatattcaaaatgatgactaactagaaagtatcagaaaccacattttccttaaccagtactgtctcatacaaatataacataagtcacacaagtaagtttaaattttctagtaggtgcatcaaaaaagcaaaaagaaccaggtaaaattaattttaataatgtactttaacccatatctaaaatgtgacttcattgtgtaatcaatatgataaattattcacatatttgacctttttgtactaagttgttagaatccagtgtgtatttattttgcacttgtggcatgtctcgattaggacgagccacatttcaaatgcttagtaaccacacatggctactggctacagcattgtacagtgtggcaaaagtttctctcctttttctcttttcccaggctctgttgaaatttttctttcagaaaaatatttaaataggatatactctgactttgaaaaaatacacatatgtgtatgtttatataagtatatgaatatatacatgcatatttctatctatctacctgtctaatatctgtcatcgatctatctacctacctacctacctgtacatctatctctctagagatcttctccacaaaagcaaggaaagagaatctctgacactatattttcttaatgaagatggagaagtttttgcagttctcattatttcatttcaggctttcagatgttcaggagccctttactagaaggttgatagattaataatctccccactaagcttatagcttagcagacctccatggtggccatgatgaggattcctttaacacatgattggcccttagtccccatttctctggtgtgagttttcagcttttgttaccacatcaaagctccggcaatttgtgcaggaaaccccttgaagcaatcatgaacccacttgtactgtaagagttcttacttccatgtcctaaaagaataataaccacaaaaggatatttccttgctaatggactggggagaatggactgtgacaaaggctggtttctcattgccaggattttaatgaggggactcacctgaaaatgtctagtgcacattaggctcttctaatagtttccgagagctggagtaacagattaccactaactcaaatggcttaaaacaacagaaatgtgttttctcacagttctagtggttagaattccatattcatggtttcggcagggctgtactccctccgaaggctccaggggaggatccttccccaccccttcctagatgctggtggctcctggcagtccttggcattccctgcaggtgcatcttgccaacctctgcttccattgtctcatgacctcctcttctgcctctctgtctgtgtgtcctcatgtgtttttgtaaggacaccagtctttgagtttagagcctaccctaatctaaaatgaccgtaactttgtcacatctgcaaaggccttatttccaaataaggttgcattctgaggttctggatgaacatggattttggggaggcatcatttaacccagagcaactgtcactaaaattttcctaccaagatcccttactctagtttaattggcctcttattcaaggcctactccataagttattttggaatatagaatttcagaacagaaatgggatctgatgattgcctagttcagtggaaccctttctttaaatggaaatttagtcacagtaaaggacagaaaagaacgcgaaccaaagcttaggtgatatgtttgcaggaggaaggggtggcccacagtgacccccgctgccccctcctctttacccctcactaggctcccggaagacttccagagcatcccaagggctccacaaacccctgtttaatcataatccctttactgtagggattaaaaactactgtttagggagatatagtgaattttcccaagtcacactgcaacttgaatctgaggcttgacccatctatgaaatatccaaactgtcggtccattcatttctgcattaccaacaatggtcagttatatatttttctttgagaagagaaaagcaaaacagtccatgcttgcaattcttttcttcctttttgtaaactatgacagaaaattcatggtgaggccaaagccatgacaacacctgtgttgcctcacattgattttctgtttccaactggaggaagaggttcccggaacagccacttttgagtcaagtgtgtgaggaaggagtctctcttgccaaggactgctgtagatgattcctgcatagccagcgctgtgcagggcctccacttgagtgagcactctgttcccattctatttctcactagtattttgagtatgttccccccaaagtagagatagtatgtctttgaatgcaaaccatgggctgagccctccaaattacttttaaaaaattagcttcttcaaaaaatttttttccacttccctactgtcttaaatatactggtgcttctgccctaagacctttcaggaaaggtacatgttctacctgatttacaacaataggttattctgggtaaataatatatctgttggatttattgtgcttattattttattggaccacactatccttaacctagagaagaagcttgaggaaaggagctagggtcaggcagaagacaggtatgttttgaaataagaaaggaaaaggaaaacgtctggaaccttgacattccacaggatattgtcccatgaatacaaaaggtgatgggtagctagaacctgagggaggaggtgccttcttttggaattaaaattccagaatgttctggaaagtgccagatgcaagaccaagtaggaccagctagtaatggaaattcctcccatattgacaaggttgatgaacacatggtgggtgcagctcatggaacactgggaggtcaaaagcggtctcagttacctttgtacaatggacatggcaccccaggttaacacaggggccacctgcccagcaggcatgggcatcagatgaaggcattttttaaacaccttatttaacaattcagagtctagatacgagtacattctcattttaaatagttcagaaaaacagatattcccttttcctccttccaaacatattcttcccttagaggcaaccaacattattagtttaatgaatcactttccagacctttctctcacatttaggtacatacaatcacccctcggtatctgtgggggccaaaatccagaaacctctgtgaataccaaaatctgcagatactcaagtctcttttataatatagtgtaatgtttgcgtaaaacctaggcacattctccctatacggttgacccttgaactacatgggtttgaactgaatggctccacttatccacatgtttttaccaaatggcaaattgaaaatacagtattcataagatataaaacctgcatataaggagggtcactttttcatacacaagggttccacggggctgactgtggggcttgagtatgcatgggtcagggtatatatgtgggggtcctgaaaccaatcttctccatatacagagggacaactatactttaaatcatctctagattacttatgatatgtaatacaatgtaaatactttgtaaatagttgtactgtattttaaaatttgtattatgttttatagttgcattgttatttttattgttttaaacaatattttcaatccatgattggtcaaattcacagatgtggaacccacagaaactgaggactgactgtatatgtgtgtgtgtgtgtgtgtgtgtgtgtgtgtgtgtgtgtgtagacacgtagaattttgtgatctagaagtgttaaatataagaggtaattatgtgaggtaaataaaatgtgtgcgttaaatataacaggaatactactatatgaatttttctgaaatttgtgttttaacattttaagttgtttttaactattctttggtacggacattgtattagtctgttctcatgctgctgataaagccatacccgagactgggtaatttataaagaaaatagttttaactgactaacagttccacatggctggggagacctcacagtcatggcggaaggcaaatgaggagcaacgtcacatcttttgtggtggcaggcaagagagctcatgcatgggaactcccatttgtaaaaccaccggatctcatgagatgaggggaacagcatgagaaagacccaaccccatgattcaattacctcccaccgggttcctcccacaacacatgagaattatgggagatctcatcttattcaagatgagatctgggtggggacacagccaaacgatatcagatgtacttcgcatatcatgtatagatgagaaaacaggcatttcttcccaatttttgcccatacacatgtggtggacatttttcatgtgcaccaatatctggtccttttctgcttcctggttacaagaggttttattaataccttccctccctgccttcttggagttagctgtggccatgccactggatctgaccactgaaatgtacttggaagtagtggcatgcgacccttctcagccaaagtatacaattgccggtgttcaattctccacccctctttacgcatcccatcaaatgccgatgtctgagtcatctgtgtccctgggtgtctatgctcatcagaatcctgctgctgacctgcatgcagcatgtggcacaggcaagaattaaacccttgttgtttgacatcatgcagactttggaactacttgtcatcactacataatccagcctattctggccgatactcatagctatgagcagccttgtacatgcttctctctgcacctgtgatgacatttctccagtaatgaatgtctattgaaaagttaaaacattaaattgcttttaaagtaccttcttatccctccagcccctaccttttgtccctaggctcctctgcatctgttgactttagattttttttgtattatttattcatgttttattagataaatatcttccccagacaaaccttgaactccctggagtcaaccgattcccttgcccaagcctctggtgttagtgattgtttcattaaactctagtctcaaggctaatccttgttggaaaattcgttctgtcctataagaaggctcccaggctcctagtctcaaaccactaaacaggccgcacaggtgtttagtggtacttattggtggccatgtgacattgttatttctctttgcatatttctcatatgattcacagtgtttaaaaggattacctttttggttttggaggtgcagatttagagaatgggatttccaaagccatattgtccctttcagagcacagtgagggtgttctttcttacccagagggtcaacagtgccacaggcttgccagtggatgagtttaatcaactctgactgtgtggccagtgagcaaagaacatgacaggggtttctttgaggtgagcaatgccctccgccagaacctagaagtagggtaatgatgctgaggttggtgtacactcagaactcagtactgccgcagagtaaggcagacccatcccacctgggctgtagctcccacgatggtgagtccctagatcgtaagttgatgggaagcataagaaggtcagaaccaaaccagagctttgagcgttctctcactgcattccatagtttccccgagcgctgaaattctttgcaacttccattcatttgcacatctcatctggctgtaaggcataatgtggtctgtgtgaaaaagaaacttctgcaaaagagtcagattcagagtttatggcaacatcaaggaatagtttatcagttcagctgagtataaccacttgatttagcacttccttttcatcatgcctctcccctcatcacaaaactgcaaaggctccctgtgacatccaaagcctctttgtctttccctgtttaggaaaaagtgacctagagggaactctgcaggggctacatacggaatcttgatgttgcctcctgcctgctgtactgtcctggttaaatccttcctcttctctaactctgtgtctccatctgtaaaatggggatggtaatagagcctatcctgcaggataattgtcaggattaaaagagttaacccaaaacagataataaggggttctgaagatccaccaggagcctcactcagacaccttgatgcagacagcacctggtaaacatgggtgttcagaagtatggtccttcccttacggccccttactcaatggccatccattgtctgctgagcctaggtccctcacacctatgccccaggctcctgtcctggaatcctggcttttaccaccaaattccccaaaagccccgtgagtggctgttttgagctgagggcacctgctcctactggcttcctggagccttagacgcacccagtgctctggacctcccacaccttgttgaaccacccggcacttgctgactcctctcctgaacctcatgtgcttgtgacccacgattcagccactgtctaaccagctcttccgtgtgcagccctcagagccccagctcccacggctctaattccacggccgcccctgccgtctcttcagccatcccatcccgccatcaccatggaaacctgtgggaacagcagcttttcctcatcctcttctccccttaatctccagcccactcctcctccctcttcttgtctgtgtccttcccctgagacatgttcaaatgttgtttctgcatgttaatattttcttaactatttagtgaattcatcatggcggagggagtgagcacgaatggactctgtcatacttcacagaaattaaacctgagccagctaaatatcctttcctgctccattctaaacctttatgggtctccacaataaccagtaactccatggttgtagagttcagataatcatgacataaatgtaggaatgaaggcaaacaggccggcccttcccccagatgactggggtcttcccagctggtgtaaaaccctcttctaggtcaaaacatttcttaaagtaaatgagtgatgactatgacaggtgggaaagtacataaaataatgtgattgaaatactcttagttggttctgctccattgaccctagggaggaagaaacaactaatttgtgctttctgttattgcattgaaagagagtggtgactcgccgggcgcggtggctcacgcctgtaatcccagcactttgggaggccgaggtgggcggatcacgaggtcaggagatcgaaaccatcctggctaatacggtgaaaccccgtctctactaaaaatacaaaatattagctgggcgtggtggcgggcacctgtagtcccagctacttgggaggctgaggcaggagaatggcgtgaacccgggaggcggagcttgcagtgagccgagatcacgccactgcactccagcctgggtgacagagcgagactgtgactaaaaaaaaaaaaaaaagagtggtgcttcaaaattgtgtctttttcaacgtttgttgtctctacatggtaaaatctgaatttaggcctaattcaaaatccatgagattgggaatgggattgggaatctcattatttgcattaatgtatgagactctctgagtaagtgttggtttaagtaaatttttttcttaaaaaactcagtagaaatggaactcagattttaaaatggactttaaaatggtctaaaaagtgtttctaggtacaaaatgaattggagtttacctattttttccaaagggcaggtagcaggtctgaagtgagagagggaaacgttcgatgctgcgttgttctgggagatgtgagccgccggctcattcagaatgtgcagggatgtccattcccacaggagcatgtgtcgttcagccaggtgcatgttttaccttgatctactgtgcttggagccttttctttcccagatctaggtctgatacctgcccctcctccttaccctggactgtaattaaagggaatatgtggaaatccaggccacaactattttactttctgtgaataaggccatcaagttgatggcttgttactgtgggtcgatgggtcaaacatgaggcaatttggggaaacagcctaaggtggctataccacagaggccagcagagcaggtaaccaggcacaagatgcgatcgctgacgagagagctgctgtgacagagtaaggagtgcatggggaggagggaccactgaggtttgtctgcgtgtgggtaccccatgcgcagatcctcaacagccgttccaaggaagtagtcatttgggagatgaagggggtgcaggtagaggagtgggggattgagacagggaggggaagccacctagctagtgaggtttgtgtagcaagaaggtaaccactcggagcacctggagtttaatccttaaggagactgctgagaaacagagtggtgcacacttagggttattttactgagaggcaggagatgtagacagcgctgggggatgtagacaccacttgttaaaatctggcagaagagaatttagagaagaaaggtattgctgtgtggtaagagcaatgacttggtcaggatgagggtgggcatggagctctgaggaagggacgtacagaaaccaggacagaactctagccattatctcctttcttctagcgatctgacaaggtcctgctagatccttcactagactctagggcaggcttctacttagtacaactgataccaccgccatgcagccatcatggcccctcccagggcccatttgttagtaataataataataatgcttaagaagcattgagtcctaactgtgtgtcctataaactatcataacccgtatagtcttcataaagatgccttcaaggagacactcttattatccccattttacagggagaaaaaaatgagcctacgttcagcaattttaagcaaattttctattgtctcatgactagtaaatagtggaataggccagttttgttttttcaccttgactgactgcaaatgtctcagtcatgattcctgaccatcttctaaccctctaaggacccagacactcctaagtagttaaagagtctgacgttatcaatcaatggaaatattttcaaaaggtaaagagaaaagaaattaaagttatgatgatcttttaaggcaaatcctgctttcttgaagcttggtcagccctggcacaggcaaaagtgcatgtcatttcaaggcatggggcaggtgaaatggaacacggctgtcctggcgtccacaactcacaggagagtggagaatgtggaagttacatgctccatttagacatcagtgttctctactacaaaatcgtttctgcagttcattaatcagactctccaaatttgtttaactcattatttataacagcattaaatccagtgacaccaaacggtgtcaccatgagtatcaggaagtctgattttaatcctcagaaaatgtgttcaatgtctttccctccctcctccacacttaacagggacagtgaatggaagccagtgttaaatttgcacgatgtgcagtggtctaaactttcactgaatcctaatcaacttaatatcctgttgcctttttgaaatccagtgatgaaatgtaaccctgagacagcttaaacagaactcaagcctggatgctctctgcaaaatggtctaatttggtggttatagcgctagtattgtatgtacaatgatcaaatcctgtgttttcaattgtcctttttatggtcaatcaaggcggtcttaggatatagatttaatatcgcaagagtctaatgtaacaggctaatgcatgccctccagttacagggagaatgtctttttgtgacagtggttctctgggtacgtcttacaggcttctatttttgaacttgactccaagggccaaagcagcacattttggaaatggttttgtaaactgtaacgaaggtatctttcttcagcagcttcctgcccaaagacgccagagtgctttacaaacttatcaaagtgatatacagggatcgttttagcctctgctgaaatacaggggcccaggggggaaattacagtcattgttgaaaaatcttagattgtcaggtcgacaggaggagggagagtgtacagcacctaaaatatcctcccaaactggatggcatgtcccaagggctgtggtcttatctactgcctgctgcaggtgacgtttgtgaaaggggtcctgtgagttttgatgattgtctctcttagacatgctggtaatacagctccttgtaaagctgattcttcccttggatttgctcatctcatatcagagactttaaggtaccctctgacatacaccctctacaaaataggcatgttgcattttttggcatactagaccatcagaaggggaactgctatatcacagcctctggaatcctggctaactacagggaagagatgtctgaattatagcagaacatgaaagaaggcagcttgtgctttaaaggaggtgttcaaagcatgtctgagcagagacttttgggctctgttttaattaatactttaaaataattcatatttaaaatatcagatgtttccataaagaggaggatgtttaaatgcctccagactacattcctttttattcttgattttacctgggagtccaaagttcaattccataaagcaagcgtttatttgtcactttcaatatacatcgattgccatgcttaagatgcaatatgggctgcggaaataggttaacccacaggctcccagggcccagtgtagaaggtgagagattcgtgtaaaatgattcaaataaaaggaagaccctggccgggtgccgtagctcacgcctgtaatcccagcactttgggaggccgaagcgagtggatgacgaggttaggagttggagaccagcctggccaacatcgtgaaaccccgtctctactaaaaatacaaaaattagccgggcatggtggcaggcacctgtaatcctagctagttgggaggctgaggcaggagaatcgtttgaatctgggagttggaggttgcagtgagctgagatcgcgccacagcactccagcctgggtgacagggtgagactctgtctcaaaaaaaaaataaataaataaagtaaaaataaaaaggaagaccttgataaatgccatgatagatacattctcataaagcccagtagcatattcgggaggtttatgagaacatatcaataatttttatgtttgttaaaatattttaaacaatatttttatgtttgttaaaatatttagttgtagtttatcttaattttaattttgaagtaacagagcaggagacctaaaaaatattccctactaggagatagttgtggaatatatagcatttgtatttctacatttttatgtgacacatttaggtgttccttaaataaaatgaaattgaccaaagttctggttagtatgtagcaaactaaaattatgtgaaaatatccaaagccttaacagagctaggatattcccgcatccacactcacacagctactcactgtaaaagtgatcgttgacaaacataaggaggcaaataaaagggcatagcctttgtcttttaaaccactgtgacaggaaaagttatggggagtgggtcagtgaggaaggaagtctgaacattgctgcattcaacagagaaagtaaatgaaaggaagacgcttacaaataagagagaagaaaggaccgcattaactctaaagaaggggctagcaggtcctgtggagccgatggggcagtgcaaaagcctgaccatgctgatctccattgggtgggtccaatggaagaacgctcagggttacgtcaggaaggtgccctagttttggggaaagaacatttcaactcaggttcagaggaaaatttagatatgttaaaactttagataagttaatagacagggcagaaatgaaagaaagaaagattcttcacagggaagtcctggctatctaactgtgaaaacctgaaagatagttgagaaaggcaagagaggcaagaaggagtggaaatgagggggattcagtgagacatacgcaaagaaagggagagaataaaatgatacattcaaagaagcgtattgtgacaaaatgtgaacttctctaataaactcagtttaaaagagaacatataggccaggtaccatggctcacgcctgtaatcccagcactttgggaggctgaggcaggcggatcatttgaggtcaggagtttaagaccagcctgaccaacatggtgaaacctcggctctactaaaaacacccaaaaaattagccaggcttggtggctggcgcctgttatctcagatacttgggaggctgaggcgggagaattgcttgaacccaggacgcagaggttgcagtgagccgagatctcactactgcactccagcctgggcaacagagagagactccatgtcaaaaaaaaaaaaaaaaaaggcatgtaaagtaaatggatgcacatgtgaggagcagcatccatgacccatcacaagtgtatgggatcctaaagcttcctgacaattgcaaatgttaaataagccaaagatcacaaaaagaggtttgttttggcagttgtgcacaaacctgctgcgaggcagctggtgccctggtaaaaggtggcagagcaaatgcagaaccacacaggtgccgggtacctcctttctgtggtcaaagaaaataatcatcaccctgcaaaagggttggacaaatataaataggagaaaattgaaatccaagatagttgagaagattataagtgtatcctactgatttaaacgagttcacacctatgaaactagatgaattatttctcacagaagacccggagaaaatggtgattagaatctctgcaccagtttctgtgatttttttgagacatcctgaagatgagaggtgagtagacagcagatgggcagggccagcatggtttttgtctggttatttatttctgtggaataagttcctagaaataggatgtctctctgggtcaaaaggtatgtacactttcacttttttttttttttttttttgagacatagtgtcactctgtcacccaggctggagtgcaatggcactatctccgatccctggaacttctgcctcccaggttcaagcgctcctcctgcctcagcttccccagtagctgggattacaggtacccactgccacgcctggctaatttttgtatttttagtagagacagggtttcaacgtgttggccaggctggtcttgaattcctgacctcaggtgatctgcctacctcaaccccccgacaaaatgctgctattatgggtgtgagcccctacgcctggcccacactgtaacttttgatacatattgactaattgctcctctccagagtttgtacccaaattataaagccacccagagtatattagaggaccatttattatacctgtttgataaaactatgcatttttatcaaccaaatttttaaaaattaatgtggctttattgctcataaggtttaacttttttcatgtatttattggccatttacatttctttagtaaaatacaagtaatgttccttagtacatttttctgtttggctttttgttttatagtactcatagtaattgatatgacaagaatatcaattttttgttggcctatatattccaaatgtgttttttaaatgttatatttcaatcttactttttacatctttgtcatatggcatctttactttttaaactgttattttagattcaggagaatatatgcaggttagttatataggtaaactcatgtcatagagatttgttgtacagattatgtgatcagcctcgtactaagcctagtatccaatagttatttttttctgatcctctttctcctcccaccctccaccctcaaataggtcccagtgtctgttgtttcccctttgtgtccatgtattctcatcatttagctccaacttataagtgagaacttgtggtatttggttttctgttcttgtgttagcttgctaaggatgatggcctccagctccatctgtgttcctgaaaaggtcatgatcttgttcttttctatggctgcataatactccacagtgtacttgtaccacattttctttatccagctcaccattgatgggcatttagtttgattccatgtttattgtgaatagtgctatagtgaacatatgtgtgcatgtggccaacattttaaaagaaatggagaaggtaagttctggaaactggtagcagaacttaagccgcggtataattctgaacaggtccatctgttcgtcatcattcatctactctaaatccatgcatctctgttcattcagcaaatattgattatgtgcagtgtgctaggcattaggaaatatgctagaaaacaaacagaaataatagtccttgccttattgaaacttagagtcaaatgaggggaattattaaacacgttttgtgaattttaagagggcaatagtgagatttgtttgatagaaagagtaatatcgagatcaaaatgtgtgtgggtggggtcacgatctttgtgttagtcagggcctttgctactgcaagtgccagaaacttaaatcaaagtggctgaagcaaaagaacactgcatgcctcatgtatgcgagaagtccatgaatagggctggcttcaggcctggctgggtgtataaattcagatggcaccctccaccaggacttcgtcttcatctctttgcttggcttttgtctgtgttggctccattccccatgcgtcaccccttcccaaacctcttacatgtttttattttcccataagttctcccctcataatgcaaaggtagttgccagcagctccaggctcacatccatccttcagagaaactccaatggaaagagtctaacacagttcaaaccaaagcacaggatgaagttcacttaaatgaatatgggtcctgtgctcgtccatgaatcagtgatgtggccaacaaagacaacatacactggtgatcatgacctgggtcaaagtcaaatgcccctcctacaactaggaatggagtcaccccatctgtaaacagactgagagtctgtgggaacaaggcagtttcctatggaaaagaaaagaatgctgtctggtgaggctgtctccactgcaggccccactgtggatggtgctggtcagagactatcaggggtattaggatccattttttaatcttatattctctctcacacactctcttttttccccctctcttggcttgatttcactagttagagccttctttacaaaatcagacagaagggttaagaatggacatcattgccttgtttctgatgttaagtggaaagtatttcatctattaaacatttataccactaagtatgatgctccctgaaggcttttcagatgtgctctttatcatattgagtgagccccattcaatttcaaatttgttaaaaatcttttatcatgaataagtgttagattttatcaaattttttttctgcatcttttgagatgattgttgtttttgtcctctagtctattaattaagcttattgtattaattgattcttgaatattaaaccaaccttgcatacctttaataaagcctagttggttattttccttgaggtgtacaatccttttgataagttgtattagttttctgtggctgctgtaacagattaccataaatttggtggcttaaaacaagaaatttattttcttacagttctggagcccagaagtccaaaatcggcatcagtgggtggaattaagtgctggcagagctacactctctccagaagctctcggggagcttcatttcttgcttcttccagcttctggtggcagctggcattcctttgcttgtagtcacatcactttgatcctcaaggccactatcttcaagtatcccttttctctggtgtcacattgccttctctatctctcatagaatctccttctcaattccatttataagaaaacagtgctggcatttagggaccacctgaataacctaggatcatctccccatcctaaaatatttaattcaatcacatatgcacagacatttttttccaattcaggtagtatttacaggttgcagggctcaggatctgacatctttgggacccattatcagtctactaactatgttattaaatatagcttgcaaatatgttgtcgaggattttgtttttatattcctgagagatattggtctttttttctttagatatctttaaatggctttggtagtaatgtaataatgtaatagtggcctcatagaatgagttgggaagtgttctctcctcctatattttttgggagagtttgtaaaatactggtattatttcctctttaaatgcttgataaaacttacctgtaaatctatctgggtctgagcttttctttgcagaaatattctaaattactgattcaatttattattattattatttgtttttaactgttttctgctattaagatttttaatttcttcttgaaccagtttggtaatttgtgtcattctagaaatgttttctatttcatctaaatagtctaactgttggcataaaattattcatagcatttccttataatcatttaaatttctgtaagatcagtggtggtatgccctttgttatttattaatttggtgatctgtgtcttctctcttttatcttggttagtttaggtaagatttgtcaattttgttgacattttcaaagagcaaatttttggtcttattgattttctctgatgcatttgtaccttttttgtgtacttcaaagaagccattggcaaattaaatatgactggacaacttttcacataagtaactaggaaaggtaaggaaagacacagaatataattcaagtccctgaaggcctgtattacagaagaagacataggcagattctttcacatgccagggagtagaactcagattagtgtatagaagtttcgaagaagcaaacatgagtgttgttgcccccatcctagaacacagactctagaatcaatcagatttagaccctaattctggccttgcccctcttcttgttgtatgtattaattaaggtaatgtatgctgctataacaggtatgccttcaaaactcaggatcttaacaagttggtacttatttcctgctctggagagaaaagctcacagagaagaattttatgacccatgcctgaaagtgagaattctacttatgtgcacattctgttgactagacctaagggaggctagaaaattagtcaaatcatgtgcccgagaggaaaataaaatctctttggtgagccactagctagtctgtgccacactgtataacctggggtttaactactttttgagcttctgattccttaaatgtgagaagggtatacaggcctaccttgttgatattgaggatttgattccagacaacggcaatcaaggaaatattgcaataaagcaagtcacacatattttttgtatcccagtgaatatgagtcatatttatactgtagtctcttaagtgtgcaatagcatcatgtattttagaaagtatataccttaaagaacattttattgcaaaaaaaatgttgacatagagactcaaagaacacatgttttaggaaaaatggcgccaatagacttgctcaatgcagggttgccacgaagctgcaatttgtaaaaactgcaatatctgtgaaatgcaataaagggaagcataataaaaggaagtatgcctgtaataatttctgtcacatgggtgtgtccatactgctcagtatctggcacaaggtgggaatttgatgaacatttgttccatgagtgaagtgagtttaaggactggtgtgcatggtatgctcagaactacatttggtttatagtaagggttcagtacataagcatatttactgctgttattgttcttaagactttagagaggaataaagccagacaagaacattttaagctgaagtttgaagagtgaagtttccatctctaaaagttttcaggcaaaggccaactcttagggaggtcacagagtcctacttttgtactctgaggctatggaatctagtggggcatcagacaaaccatagtttcatttactatcttgtaacttcaaggaagccactttactttcctgagtctgtttccttggatccaaaaacctacttagtaggatagccatgaaaattcagtgagataaatcatatgaaaccagaacacagctgatacatgcagtgaagcggctcttaaatatgtgcttctttcctcttacttcgcttcctctttattttttcctggtctatgatacagaaaatcgtctgaattaattgcatttgaaacgaacattggttgtaatttaagataaagagaaaattcctaggttgggaattgggatcctggttctgcattttcccagcccttcctctctgcaaatgatcacagaattacatagtctggaccccaaaagcaatatcttctgttacttaggattcaaggcacacatgtttgtaacaattggcttctcaaaacttgtaagaactactgatgggtaaacaagtcatgaatcagttttttatattcaatcaaagttgatggagattacccaattaaataactggtatataactagtttccctatttccttttccctgtttcatagaaaaactagttatacattgcttttctgtaagaaggtggtaaatgtaaattgagaagctcgaggttagcaaaacagaagataatgatcaaaggactccatgtctatgtggttgctttatgataatgctgaatagcagccttgttcatgcagagacaatataaaagcctttccccaacttctccccctcctccaattcgtaaaagtcaacataatgttaaaacaaaacaagaagtttagaattaggatgaaacccatctagtaatacagtaatgtcaggaggacaatatcaaaacaaatatttatttactcaggtggtggttgcggttttcgggctttttctcagctgcggtgcatttgtggcttttatttctgcactgccgcttgttacttggagccattacttcctatctgtgttgtcaatcgtgtcttgaggttattctagcaccttacgaaaagccaccatccacctaattttagagcttttaagataaagcccgggagcactaggaaggtgagtgagttaccgttatcaatctggaatgtgaggtttccagtgcagtagcaccacctcttctaggtcaccatggccagcccttctcagaatacagaatgatgtaataaataatgcctgtgtgaagtgaaagctttgagcaatggaaccagctaacatctagaattttattaggcacaaactttctcagatgttctcagtgctattattaccccctcgttaaagctggtaattcttgtttttaaagcactttggagacactcattgatacatgcctgaaaaaaaaatagatgtttattttttccttaaaaacttcgcatgagactttagaaccgtatacgaataatactctgattactgaagtgggtggattttccagtctttatttttcttccattaatcatcttaagagatccaaactttccctgccatgaaatgccagacttcatgctgcaagattcccctagttgaggggaagggcagagccaaccagagcccctggccctctgtcaggggctgcctcctttagctctcagtaataccatcagctcctggcctccttatcaaagagggaggaggtgacataaaattagagaaatggcccagagaggtggcccctcagagcacccctagctggtgtttaaaggggagcagttatgacgttgttactgcagataattgccagttgagtgtggaggccctgtgttgccagtcccacccactgatcaggaaaagctggtaatcagccatggcatttgtatgctgggaaggaagaacaatgggctacaccagctttatgtcaatcagcattgccctgacatcccctatcagacttctgcttaaatctttttggctagaacaggtcatgcactagctgcagaggaggttgacaaagtgagtattcgtgtccccagccattgtggcagatgaagatcaggggaaggtttttaggaatgggtatggcatggccaacctgaacactgcctaccaacatgtagacatgatattggctgggtattaaaggaaacaaacatgtcagacagccagaaatggcccacagcccatgaatttaaaacctctacctaagagcagcccattgctagctctcgcaccctctctgcccttgacctcaataatataccatatcttgattcactggctccaggtctcctaccaccgaggacttgccttactttttttttgttgttttctccatggagtccatctgttggaacattctgtctacaaactccttttgttaggtaataatgagttttcccattttaaaaaattcagcaaagactagcagagctgccaaccagagcctctgatcaacacaggataaccagcaggagagttggtggaattccagacagtggtaagaaaaaaaataaaaataaaaaagacattttaattagtctgtgcagctttatcttgcataaatggatacattccactaggccagggattcctaactttttctataaaggtccaggtagtaaacattttagactttacaggccacagggtctttgttgcaactattacttcttgccattagtgtgcaaaagcaccctagacaatatttaaaatgaatggacatgacagtgttccagtaaaacgttatttccaaaaaaaaaaaagaaaaaaaaaggccagaagaccattgttttgcagatctcttgcatgaggcttttaaaggtattaaaacattttcgcacccctgtgcctgttttcctgaaagtttagagatcctgagttggaacactgatttgcattataaaccttgccctgaacaattctcagcctgtccagattgctaagttctgcatgacattcttagtaatgatgtccccactttcttccctctgctctgaagctcattcttgttgagcttgatggcattttaggcttgactttctctagaagtcttcactagattcctagaagagggaggcacagaagctcacaagctctaggtacaaaagccttgaagctttcgagaagacagataagccaggaagtgattctagctctgctgtatatctgtgtaaccatagttattcacccaacctctgagcagtgtgaggcatggacaggaggacttcaaccaaactggggttttcatctcagccatgttcatccaggggtatcattggtccattagtgatgaagatgttgtattaatactttactatgtgttttattccagtgtccggttataattgtataagaaaccatcataaacttaccatcttaaagcaataacaatcatttgttttactcacaaatgtgtcatttgtgagggctcaatggggactattcatctctgtttttcacggtgtcagttagggtagcttgaaggctggggtaactcaatagctggaggttgggctcctttattcattccttaatgtgcttggtggttgattctggctgttggccacagtatccacacatggcctctccacgtggctgcttgggcttcctcacaggatggtaggtggtgccaagagtgagcatcccaagggaacaaggtagaaatgagtgatattttatgactgaggcttgactttaccatattttatagcagttggggcagtcatagattcccctgaggtcaaggagacagaaaataaactcctactcacggagagtcatgtcaccattaccttgcatcgtgagcatgagagatgtaatatgatggctattttgggaaaattcagtctcccatacagaatataacttgagctattttcagcccatgttttaccatcttcataatgccttatagttgaagtaatataaggatacctcacgtgagtagaggctgcgggtatttagaagacccaaaacagatgttaaatgttcatatgtgccattttctcttcctataactatttttcttcttctttctctgggaaactccagcttacattttacttttcggcctagaaactgttcctcaagaactcttccctagtaagtgatcccatagaacgccatgtttccccatcatattcctcatcacactgtattgtcattgccagcttatgactttggtcgtgagtgataacaggtaaggaaccatgcctgtgttactcaccgctcagtcctcagcccaggcaccctgcctaacacacagccgatcatcaacaatgtacttattgagtgaatgagtgaccagtgctaatgagttactgaatattgagagaattggttggtacttcataaacaattcttgaacccttcttaaatagcagtcattgtattagatattggggctataagacatggtctagttggggagatatatggttctaataataatttacatttagtagctatgtttttgctgtgtatctctcatgcttttcatgcattgtgatggggatggtgacatgcctctcagcgagagtagcagattgttttatttcagaactatgatcataccatttgtactatttggtcatttttctccattcaataatataaagtaggcagtcgtgtatgtgtgtgtgtgtgtgtgtgtgtgtatgcgtgtgtaatccacataaggctttttgatgactgcatattatttctcatcattgctgtcttctaattcatttgaccagtcctgtaattgatgggcatccaggttgcctctaggttttcacttcttataagcattgcataaatgatatttcttcatgtggacccattgcatgtggcattgaattatagaaatgatactgttgaattgaagataggcccaattaaaattttgacacagaccattaactgtcacacagatttatattgccaccaggagcatttgaaagtgttctattcaattccacacaccagggatactatcatccttactcaatatctgccaatcctttgggcaacatagaatattctactgttgttttcatttgcatttctcttaagaccttatctggagaattatgttttttcaacataaataaataagaattgtccaaggtaagagttgtgtaggctctgtaaaaactccccaagtttcagtaatttacagatttgaatggataaacatccttattgttcttaaatactaaagtaagagcagatgtaagaagagcttacactttttattatatctgacattcaatgggaaaccactggaaaggttggagattggggtgaccagtgtttctgagatgaactgaaaacacttagcctcttttcttcttatgtccattcttctgtgtattgataaagcctccatttttctgacattggaatgggaagagatgtttcagtctcagtctaggttcaatattaccaaagtgcataacattatattcaatttttgcctggcactttctaagagatctctgatttgtagttgtagtgatgactttcataatctatttttggaaccattgtttgtattttttaaatgattagatcacctttaaaaaatatgctatcattccaatcaggttgataccatttgtttttaattgttcactaaagtatagcatatatcatagaaggaatgtttgtgctccccagaattcatattttgaaacctagcttccaatgtgatggtgtctggaggtagggctttcatgaggtggtaaaatcattaggactttactctcaggatattatgagattagtgtctttataaaagagaccccagtgaactcgctcgtccttttctactacatgaggacacaatgaaaagacagccattgcctgtaatcccagcactttgggaggctgaggcggggtggatcacaaggtcaggagatcgagaccatcctggctagatggtctagccaggtgaaaccccgtctctactaaaaatacaaaaaaattagctgggcatggtagtgggcgcctgtagtcccagcgactcgggaggctgaagcaggagaatggcatgaactcgggaggcggagcttgcagtgagcaaacgtcacgccactgcactccagcttgggggacagagtgagactccatctcaaaaaaaaaaaaaaaaaaaaaaaaaaaaaaaagaagacagccgttgatgaacctgaaaagaagccctcacagacaccaaacttgctggtgccttgatcttgtacttccacctccagagctataagaaataaatttctgctgttaaaaagccacccagtcaatcatatcctgttacagcatcccgaagagaccaagaaacatacctgtagaaaggagtagtcataacaaatctatagattgattagttttcacaaaccaaacacatacacataacaacactcagagaaacagagttatgactggccaccggaagccccatgccctctcagtcatattccacaagggaaatcactatcatgacttctaataaaatgcattagtttgtctctttttttttttttttttttttttgagatagagtcttactctgttgcccaggctggagtgtattggtgcaatctcagctcactacaacctctgcctcccaatataacctttgtatttttaagagagatggcattttgccagttggctaggctggtctcgaactcctggccttaagagattcacctgcctctgcctcccaaactgctgggattacaagcatgagccgctacgtccggcctgttctttatgtaaatggaatcatagagagtgtactcttgtgtgtctgtatgggactctctctttttgaatactgtaatagatcaacagctaacatttaacagagatgcaccaggtacttttctaagcactttatatatgttatattaaacataggtgtcttaactatggattatatgggaatgttttaactttttcttgaagtaactttatggtttgtatacggatgccaaatatagatacatatctaatttatctattttatttttttagaaataatttcttagaattaggaacctcttcagagccataattgcaaaaagagctccccgtcagctctctttgcagtcgaggtttgtaattattcttaaaaagaaaacatattaagatgttcttaggactctgagtagttatgccctcagataaatgatattaaactaagcacttaaaattaaagctataaagcattggtgatgcccagatatatcagtactccagttcaccctaggtgagaagggcagtggggattaatagccccctctgtccatttcctttttaggaaatgatgacctatcagagaggacataaatcactcctcttcccaaattagattaaaatcctgagctttaaaacttgcttttacctgcagactctaatgttcgacttgtggctttgtcatttccccacaggggcagcttccgctggttttacaggacagaaaagttctgtttctattactgaagaggttgaaccctctgctgaagctaattccaaacaaagtaggcaccatatcttctttcaaaagatcccttagggaataattgcaaagagatgctgtgattaggtaattacatgtgtgactctgcccaagaaacctgctttctacctaatttatactttgatttccctctctcgtgtcaaaaagcatatctagccttatttatctgactaccctgcacagaattttctcatcatgtaattgaaggtcactagaaaataatacttttttgaaagcgtgtctgataacaaacaaacaaaaaatggttagaatcactgctaaatatgaataattctattttccaatgctaaaaatgcacatctgttccagaaagacttggactcacatcctacttttcaaaatgcttcagccattcaacccttgatgctatgggcataaatgaagtttagaagttctataagcagtggggaagctagaattggaccttgaggtcccccccttttttttttttttgatgtttgttaggaattaagatggccttaggtattagtctgttttcatgctgctgataaagacatacctgagactgggtaatttataaagaaaaagaagtttaatggactcacagttccatgtggctggggaggcctcacaatcatggcagaaggcaaaggcatgacttacatggcagcagacaagagagaaaatgagagccaaatgaaaggaggaaccccttatagaaacatcagatctcatgagacttatttactaccaagagaacagtatggaggaaaccatccccatgattcattatttcccacatggtcccacctacaacatgtgggaattatgggagctacaattcaagatgagatttgggtgaggacacagccaaaccatatcaccttacaagttccatgtctagtacagagcttgaccctaagtggatgttcagaaagcatcttcagaatgaaaaggggggcacagttaagacctctggtaaattgtacgatagcttgtggggggaaaatcactgtagttagtgggaagaatgtggcttctttgcttaggacagttgtggatttactggctgaaggaatcactcacagaagtcattctacattagtggtcaaaagcatatgcttttgagtcatatagatgtaggcaaatcattttaaagattgttgctatatttttagtataagtgtgtcctgcccaacattgacacacacttattctaaaaaattgtttatctgagattcaaatgtagctgggcaccttattattgtatttgtttgtttgctttgaaatcctaactcagtcccactagtcccatttttgtaatgtttagctttcaggcaacaaccgctgaagaggtaaagagattatttttgaagagtcatgtgattttggctgctcctagctgacctactagagaaaaatcttaacattttccacaaacttttccattaaaatagaggataggtcattgctaaagaactggcagagcttcccaagacaaaacttgtggatagagtggaaactatgatctagcccgtccagtgaggtagactcaagatcaggtacataaactttactgaaaaaatgtgttttttctcatgggacgtatttacttgaggaagtatttaatcccttagcatagacctttaggttttcaatgaaaatatgatgagttgaaacatttgatatgctgatggcattctgactgatacttttcataacaaattcagaagtgaaaaataatttggtatgctgaaatggtggcctaaagtgtgaacgattaacttaataggaacaaatgtaagattccgtacttgattctaaacaatgaactttactagtagagaagttgactagtagagaatgaagtttactagtagagaaattgggaagccatgatttagtagaggcataaatgaaagcaagggttagcattttaatttaattttaatatcagtatattgacttaccaatttcatatttttttatatttttatgacatatctttgagaaaggggtttgcatgaatctttaggaaggctgaatcaaatgattcagggttgggggagtgatattggcagttacatgttgtattagtccattctcatgcagccatgaagacatacttcagactgggtcatttataaagaaaagaggttttaattgattcatggttttgcatggctggtgaggcctcaggaaagttacagtatggccgaaggggaagcaaatatgtccttcacatggcagcaggagagagaagtgcagagcaaaggggagaaaagccccctataaaactatcagattttgggagaactcattcactatcatgagaacagcatggggagactgccctcatgatccaatcaccactcatgaggtccctcccccaacacgtggggattacaattcagattaccattcaagatgagatttgggtggggacacagaaccagaccatagcattctgccacttgcccctctcaaatctcatgtttctcacatttcaaaacaaaattatgccttcccaacagtttcccaaagtcgtaactcattttggcattaacccaaaagtccaagtccatagtctgatttgagacaaggcaagtcccttccacctatgagcctgtaaaatcaaaagcaagttaggtacttcctagatacaatggagatacaggcattgggtaaatatgctcattccaaatgggaaaaactggccaaaacataggggctacaggatccgggcaagtctgaaatccaacaaggcagtaattaactcttaaagctccaaaataatctcctttgactctgtgtctcacatccaggtcacattgatgcaggaagtgtgttcccatggccttgggcagctttgtccctgtggctttgcagggtacagccctcctcctggctgctttcatgggctggcagcgtctatgacttttccaggtgctctgtgcaagctgtccatggatctaccatcctggggtctggaggacagtggcccttttctcacagctcaactaggcagtgccccagtggggactatgtgtggtggctctgatcccacattccccttctgcacttccctagcagaggttctgcatgagggctctgcccctgcagcagacttctgcctggacatccaggcatttccatacatcttctgaagtctaggcagatgttcccaaactccaattcttgatttctgtgcatctgcaggctcaacaccacatggaagctgccaaggctcgaggcttgcaccctctgaagccacagtctgagctgtaccttggccccttttatccatggctggagaagctgggacacagagcactaagtccttaggctgcacacagctggggggccctggctccagcccacaaaaccattttttccatctaggcctcagggcctgtgatggcaggggctaccatgaagatctgtgacatgccctgcaatttccccattgtcttggtgattaacatttagctccttgttacttatgcaaatttctgcagcaggcttgaatttctccccagaacatgggtttttcttttctattgcattgtcaggttgcaaattttccaaacttatatgctctgcttcctcttgcaagctttgctgcttagaaatttcttccaccagataccctacatcatctctctcaggtttaagttccacagatctctagggcaagggcaagggcaaaatgccatcagtctctttgctaaagcatagcaagagtgacctttgcttcagttctcaacaagttcctcatctctgtctgagatcacctcagcctggacttcattgtccatatcaccatcagcattttggtcaaagccattcaacaagtatctagtaagttccaaactttaccacattttcctgtgttcttctgagtcctccaaactgttccaacctctgcctgttacacagttccaaagtcacttccacatttttgggtatccttacggcagcaccccgctccctcggtaccaatttgctttattagtctattctcacactgctacaaagacatacctgagactgggtgatttataaagtaaagtggtttaattgactcacagttttgcagggttggggaggcctcatgaacttacaatgatggtggatggggaagcaaatacgttcatcttcacatggcagcaagatggagaagtgcagagtgaagggagagacagctccttataaagccattagatcccatgagaactcactcactatcatgagaacagcatgaggggaaggctcccatgacctaatcacctcccatgaggtccctcccccaacacgtggggattatgatttggattacaattcaagatgagatttgggtggggacataaagccagaccgtatgacatggtgaaatagttacaactgttttcatgaagcttttttggtctcaagatctgtgtgctatttgaataaatgagatgcagctggtttccaacgtgttttcctagcattggggtttaaagaaaaaagtaaaaaggacctaccttggaaatcatttcagaaaactgattcttaagcagtgattctcgaacttgagtgtatatcagaatcacgtatagcaggggtccccaacctctgggctatggaccacagcaggagagtcagcaataaccccctgagctccacctcctgtcagattggtagtgtcattagagtctcatagaaagtggctatgttgcctggggtatataccctggggtttcttgttgtgtaccaggaaaatttaggtcatggacacacacgaggagtttaggagtggaggtttaacacgtagaagagaagagaaagagaaacagcttcctctatagaggaagtggtcttggagcagaaaaagaccagcgggtggcagctgtgctgaattttatagtcaggtttaaagaggcagtgtctgatttgcatagtgctcacccattggttctgtcaggtatgatgtttacacagggcatgggcaaggctggtcaccccaccctaatcttatgcaaatgggctttccagttgattggcaccatcttgtctgcttcttactgtacatgtggctggcagagaaaggaagacggagctgccatcttgaacatgtctagtccttagttcctgccagcattcacctgtgcaagtctccagcttgcttgtctatgtctgcagctcaactttacattttctttgttagaaaattatttggggttgctttttattaaaaagaaaagccttaccaaggattcccatgcccttaccatctgcctgtgtaatttcttcttaactcctgtatcatcaggaacgtgaaccctattgtgaattgtacatgccagggatctagattgtgtgctccttatgagaatgtaatgcctgatgatctgaggtagaacagtttcaacccgaatccaccccacccaccaactttccccatcccatgaaaaaattagcttccacaaaactggtccttggtgctgaaaaggttggaagactgctgatctatagggtttattaaaacagtaggccccccaccttcagcatttttaactcagaagttcagggatgaggactgagaatttgcatttctaactagtcccccgagtggtgatgctactttagatcgtaacgttcatattgaaacatttgtcctacctacggatgccaatgaccaaggcatatgttggacgagcactgtgagaataggtagaatcaactctacttgagtgcattgcccacacaactgcttagtcttgtgtgcgtttagggaaagaacaggtggggagtgggggaggtacacttcgcccaaccatttgcttgtagatcttcatggactcctcccagagttcacctttgaagactaaggtatggtagtgccaagagtggagatactcctttatcagggcctctggggtcatggtcctgggctgtgacctcagcacgacatcagcacaaccaaaacaaaccacaggctggtgtttaggttcttgtcaagacctcatgcatcattaaacagagggcaactgcagagctctccattctgttttaagaaaatagaaatagtaactagcattaaactaaacccacaaacgcctgttccctcttgatagggtggtcacgctactgctgcattgttttgctttttcttttttttctgatgcagctatagtacaagccgtgactcatgctaggtgctagcctcacagatatacataaacattcacaatcaggtttccaaagctgtttccttacttccctttgttgctattttacttttcattggaggttgggcgaggcaatctttaaatgaagctattttttctttgtctctctgtccctctgtgtctctctctgtgtctcacacacatacacatgcacacacacacacacacagacacacacacacacacacacacagtctagctgaatcacgaattccgtgagaacagagtcagcatttgtatattttctcagagatctattcctaaccttaatgccatacctagcacatagcagacacacaaaatttgtgactgactgaatgaataaacatgtatattattgcaagccagttgcaaacagatatattgttgcaaacagaaggttacctgttgatccttcctatgttatctctgaactgcaggaacttcattttttctatgaaccaaatgtaggtcatcatgaatcaagcgtccataatatctgtttgtccacatataacctattttatagcagagcttatattctgatgatttgtagatttaatgttgtttattcatcatatctatcacatttgttttttaaatatttctaaacagctgattaaagtacaattggatggaggtaaaaatatttttaaagacgtataatataaaaggacagtaattggatatagttattcaaatgtaacacttaatttactttgagtttttacttaaccctgtaacaatggaattgtgttagcttacataattttcattgtttaattgaaagaagaagaaaaagaaaaagcagctgcaacagcggtagcaacaacacgccaaaaaacggaaagataatactttttccacttggcatttatttctgggaagaatgtatcttaagagcctttactgaaaagggcattgagttacacaggcaatagctttttcaacagctatttttccagaggtgtaaaaacagcctttgcctggttacattgtatatcttacctcagtaaagtcatgaaaaggaatcgtgataaggtgaatgcactcctacagagcgctaagcttcctggcgatttgacttgattcgggaatagaactcagtaaactgagcagattaaatgatcaatgtttcttttagattagccctctcaaatatcaatggtctctgccagccttagatgagataatgaggtaatttcaatactgagcttttgacagagtgtctgaagtgtaaagagtctgtggtattagaaacatgtctcagcatggcactgcccagcatcagcaggggccttctgagaggccaccgttgtccagagtctaagacactggtccagtggggacacatgagatgacatgggtttgtgtgtgtcttaattgcagtcctcgagaagagacaaggatgtgagtgtgtatagtttatttaaaaggtgcaggaagcatcagtactgcacacaagacaaggaaaaagaaaggagagtcaacgtagggtgcagtattaagctatggtaggcaactaaagtttaatcctgtaagaaaactctggaagtaatgtagaagacacacttcagagttatccatcctgaggagggagggagttcccttcagctggaggtacttatttcagtgctcttggttgaggactactcccagaaaaagggtgttgatttgggaacacttccaaccagaggggcatcacacctgccacatacacaggaagattcatcttctgtggttctgggaaaagccttcaggcacagaactgcacatcctgcaatgggaggttgtctggagcacagtgaagtggggtgcagtctgaggaatttggcaagacactgacagcatctcctctggtgtggaaaatggcattagaaagcagtggtcacaaggctgggtgcagtggctcacgcctgcaatcccagacatttcagaggctgaggcagatggatcacctgagctcaggggtttgagatcagcctgggcaacatggtgaaaccctgttctactagaaatacaaaaattagccaggtgtgctggtgtgcacctgtagttccagctactcaataggctgagacagaaggaatgcttgagccagggagacggaggttgcagtgagctgagatggcaccattgcactccagcctgggtgacagagtaagaccttagctcaaaaaaaattaaataaaagggagcaagggagagggagggagagggagagagggagggagggagggagggaaggagggaggcctgttgacagaacaatgaataattacgcacatacctaaagcgaatactcaggtgagatccccaagtacactctttcaagtatgggttagatattctaactgaagcaaatgtaaaaattgaatgttaacagtgggtctcttctattagtgtggttgtttgctgtcttctccagaatggatgtttttaagaagtcctttctcctcaccggttcccactagctgcaaaggttacccttacatccttgaatctctggattttttaaacccatttctctaatgctgcttataatattgttgataatatttgtcaccccttggcttgttcaaatatatttcattccactataggtatattcgcacgttttcacgctgctgataaagacatgccctcgactgggtaataaggaaaaagaggtttgatggactcacagccctcacaatcatggtggaaggtgaagaggagcaaaatcgtgtctcatgtggcagcagacaggagagaatgagaaccaaatgaaaggggtttccccttataaaaccatcagatttcatgagacttattcactaccatgagaacagtatgggggaaagtgcccccatgattcaattatttcccaccaggtccctcccacaacgtgtgggaattattaattcaagatgagatttgggttggggacgcagccaaaccatatcagtaggtcaaatgcaaagcctgaaatatggagaggaagacatcagtataaatcctggttccgtcacttgaatacgttgccttgagcaaattattcccttgcagaatctcagtttttccacctgtaaaatggagacggcaaaaattaacagtcacctcggggagtaattatgacaccagaatgagctaataaacatcactgttttgctcggtggtgaggttgagtccaaaccttagcagttatgattgtggttgttgctgttgtccttactaattactccatagattgatttgagttttgcaatcagtttgatgccttgttccatagtttcttttttacttccagatttggttcaggtaaagttggcaaagcaaggagagctggattcttcttacctgcttcaccttagctggttcctgcttcatacatctttcaagatgtttgtagaaaactaatcagcgtctacgtttgttttctaattttcttttgctcacacatactgtggccacttgattaccaatcagtgctgtgttggcaggcacatacaggccctattcctactaatcagagatgtgggaagcaaatgctggtgtttaaagggaacccttatttgagctcttgtcccatgactcctaattgttgtatttctcaaactcaacccagctgcaagctttattagggaaacatttattcagataaaagcctcagttatgaaagaggggtaattattttgcaaatgtgtttgaatcactgtatgctgtagtgcaactcatccccaaatggagaaggtgcacatttgggctgaaatgttgctttgtagatggacaatacaacaagcatatgacggggaacttctggcaaacgataggaaaatggtcaaatgaaaagacaccagtaaaatgagagattggatgaaaagtgatcaggaagctctgaaagctgaccagagtgaacaaaatgcctaaattccgttcatccacattcatttatttattcattcattaaccattgaatattttggggctcctatacatagtttgctctcaaagaattttaggttttagttgggagagagcaatgaaaatatgttaactgcatgccaactgggatctcccattcagtgaaatctagatagcgttggaccaaaaccctgttctgtgccttgagaatgctcagtgatatccatgacatttctggaatttcacgggggtgggtgctcacctaccaaaggtcccctcctagctctaagatcagcttctgcttatttcgttgttttgcttcatcatctttacattgcacaatccacgtgtagaaaatagcccttccctttcctttgtgcgccaaaatttacataaagcattgtgtggatagcacactttattgaaattctagaaagttgtatttggagattgtatcaactcccagtggaatattaaacacggctattcttaaatgtcctccaggcaccaggcacattttcttttgttgcttgtaccgagctctctatctctaaccacctccgagttttctttttccatccctgttcccatctctccttctcttaatgttctgcccagtatatgggggctatcacatggcatgattattctatattcttgctccctcattgagttccagtctcaagcacttatattcatacccaggaagttgttctccagaatataacagttctcttccatttaaaagaaacttccctcagtggtaattcaaggagttcttcatatatcctgaatataagtctgtcagatgcatgaattacaagtctcttccctttgtgtcttgtctttcactttcttaatggtgtcgtttgataaacagatgttctgtattttaatgaaggctaattatttatttttcctatcaggcttattgcttcttgtgtcctgtttaagaaatatttgcataccccaaggtcacagacattctccactaggttttctaaaagcttgcttttcgtaggtttcatgattaattttcatcttaagttaattttgtgtatggtgtgaggtagaggtcaagatgtatgatttttccagttgctgccgcaaaatgtattgagaagatcaccctttccgtcactgaattgcagccataaatcaaataaccaatatgtgtgatctatttccgcactgtctttccctggtctttatatttaaccttgtgccaatatgagggtggtaaattttaatcatcttcctttttatgtaggcatttaaaactatcctgttataagtgctctggtaatagaaatacagactataacacacgccagaggatttgacctaagggaagagggtcagagttggctttctgagcggatgtgccatttaggtggagaagtactttgtgcgtctgcattctagggcatgccctgcttggcagttttctcattttatgatgggtcctgtgatgtggccaatgtgaaccatgctgtatgtgcactggcctggaatagataacaacaataaaagaaggaagatgcccaagaagaagtcaaataacctcattgtaaagatgtgaaattgaggtttaaagagaacatgtgatatgcccaaggtcacagagttgatgagttacaatgctgggattggaactcaggtttcccaatagatccaccctcttcccatgaccctgcattgcctgtaggtacaaatgctcaaagttgctgagctataatgtggtgatgcttggactcgtactcagttctgtttaacttcagagtctgtgctctaccccgtatccttgattacctccttggaaaagctgaatttatttgtatgcctaactaagaatgagctaattgattcccattttaatatgacagctctgccttagcactatcaatatgtgtccaaaaaatcttatggtgcatgactaattgcactttggaatcgtatacatttaattatatatttgatttgagagtttagcatttacaattattgtcatctcccacttactgagcttccattcttccattctgattgtctctgttacagactttttttctcatgcatagagaagaaataaaggcacaatttcctttttccatatttatgtgttatatattcctttagcatcatgagccacatatgatagtattgctagatcagttctcataatgtaccctttgcaggatagactgtgaaaatctaattttggcaaaatgactgaaatcccagtgaatgattttttcttttcttatataaacctaagcatccaatagtgaaagtttatatgactcaaatggaagaagaattcatgacaaaaggtgtgattattcgcataagaccctgaaattcctttctgggtgaaataggccctttcttccttccataagaggctctgactgatgagttggcttttattaggcaatgtatgtctgatgcaatatctgtggataaaaccaccagcccctatcaagtcaatcaaatatttactgagcacttattatgtccaagacactttggagaacaaagaaatataacctggccttgcccttcaggctgtatcaattgagatagaatttggactgctgcaatcaattacacagatgtctctcaaggtagtgtcttgatgcttgagggaaacaagacaaaatgctattaataatgacttagttttctttgtcaagcaatcggcttgccacatcattgaggtaacttcacattttcttgcatcttttacaattagcagcttcagctgactctgcaacctgttgagaaagagggcccaggcaatgttgtccttggcatcttattcaggtctggcttccactgcagtgaatgcactcagatagccctttatcagctgagtccccttgagattaagtatttaatgtctcttgatctccagccttaggaaataacccaattcattactcagccattatgtaattcattactgtcattagagatcaggagaatcgtcttaggagaactgagaatacaaggcaaaccacacctttctttgtccagcatgattaacggactgtggaagggccctaatttggagttccattcatgggatttggttttatgacatcctccagtcccaggcttctggtatgacttgcagaggcattggttaacctggtggaaaatggattactactcaacgtgtttaccgatactgtgtgtctgtagtgggctttggtggactcctttatgggattgttgatctctcaacagaacagagaagttggtcaggaaggttattaagggagaatgcataagggagctgctttttctagactggagtgagggtcatggattgcttcccagggaacatttggcaatgtctggagataattttttgttgtgacagtgtggaccaggagtgggaggagaacatgactagcatctagtgggtgaaggccaggggtggtgttaacatcctacaatatacaggactgcctatcatagcagaattatctggcccaaaatttcagcagtaccactgttgagaaaccctgggtacctgcccattactgctcccttctaaaacaacacatatttcttcataggcccttgtgaatttatttgttttatttgatgagagagagaaagagagagagagagacagacagagactgatacatttgtacctatctatctatttacaacttctccattccctacttcatttcacaaggtattaggtaaagcaggtatataaataacactcaataaagtagttaagagaaattttaaaaaaatacacagggggaaatacaaattaaagtaggcagtagcaactgtagaaaatatattatactggtaatctgacagtctgacttataattgctgtcattttctttgagcttcctgagagccaaaacaaaaatagaaacagtcattatactttttgttatccatgaggagaaaacagtgtagagaaagcttttaataacacaaagacatttctcaagtagaacttaatgtaaataagtgttggcaaaggacaagatagtaaatattttcaactttgtgggccatgaagtttctgtggcagtcactcaactgtgcccgtgtagtccccaaagtgtccacagacaatatggaaacaaatgggtgtgactgtgttctaataaaacttaatacaaaaaaacaaagggtcagatttggctcttggaccatagttggtcaagcctcagtgtaggtcttcagaaacactcctggatcaagtacgaaatggatattaagatgatgtttcctaggccactgactgaaaccgagagctttcccttacagggtgctaaacgactttctgcaccatcggtagtttctacgaggatggaagaacaataacaataataacaaaatatcttcttagggcatttactgtggtgcatatcaaggattttgtgttttttttcttcgcggttgtttagttttgctttgggtgacaccccttctcatttgctgtgaagataccgcaggatgataaactccctcttctatactaagtcccatctgcaaggaaaggaaacttcactctgctccttccatcttgctgaatatttaaagggtattgacacaaggcgttttgataggccaaaagtattattatcctaaaaaatatttcctgtgatttaggcacatggagaggcaccgtgttagagagtcaagataaaatacctacctaaagactcttcctctgagtcatttcctagggacactctcagttcctttggtggccacagtttggctgtcatttcctctgtgaattcttctacgactctttggaggaaggatgtggtcttcacctttgtccttccgtatgttttgtaattctgaattttatagcacttctcctggcgtcttataactttatatttctctttcccctgatcaactgagcttcttgaggggacagtataagtctttctgatcttttgccctcccctgtgtcttttgcaacatgtagaacatactagatttccataactatttgttgattaaattaatgactagatggatggatggatggatggatacatggatgaatggagggagggagggaggaagagagggatggataaatggatgtgggagggaagggtggaaggatggaataatggaaagaagaacatcagcagcttctcaaaaatgtaagttctaacataagtagtaatattacttatgaaatattttattgatagtcaagcaccctgattaaacttgtcctatttcatcatataaaattaagcttaatcttcatttaggccaggtgtggtggctgatgcctgtaatcccagcactttgtgaggccaaggcaggcagatcacttgaggccagggagttcaagaccagcctggccaagatggcaaaacctcatctctactaaaagtacaaaaattagcctggcgtggtggcctgtgcctgtaatcccagctgcttaggaggctgaggcgtgaaaattgcttgaaaccaggaggtggaggttgcagtgagccaagatcacaccactgcactccagcgtgggtgacagaatgaaactctgtctcaaaaaaaagaaagaaaaaacatactcattcagtaacaaaacaaaatctcaaggcaacatatctgatttatggttcactaacataaatacatatgcctagaaattcactgaacgtcaaaatgatttatacatacaatcactagagtgaagttgaaagtgttttaagcagaatctgcatttaaaatgcatatatatttattagaaaggatgccataacagattggatacatacaatcaaattgttgctaataacactaggccaaagtctttataagtgcgcacgcctgtgtgtgtgtgtgtgtgtgtgtgtgtgtgtgtgtgtgtgtgtgatgttgtaagaaagtttaaggctatctcccttccttattcctctctctgattactgtcaatgctagctagttgatgtcagtaatgacaagtttgtattttaatttttaagcttgagtgatccatcacacctcaaccagagtaggtggttattcctactacctgcttggatgtcaaatgcatcagttggcaatttgtatttcttcagctttctctccctcctattttctgtgtttattctgtctatctacttatttcttacacaagagtgaccaagagtgtgtacccaggaggtgacggtcaagagtataacgtttcagaattaaaaaatattatagttgcaaactggatattttggataatactggaaaaacggaaatattagatcatgaaatcagatattatccatacttctgtgttaactacgataattatcttaatttgatgtttcggtttttccatttgcttattgtatgtaattttgacacatctgccttaattaataagaatggtacaaaattaagtaaattttacaaaaagacattttaaaagaactctttattcaaggaggaaacttaacaaatttaattttctttgatataaaatatcaaaagccataactagatattttattcaaatattaagcttgcaagtttgggagtaggggtgggaatcccactacagtcaaattattttgatgttactttccaggcttagagtttatcttccatatttccaatgagaatcagttcctcaagtggaattttatgataaactgctgaaagtagtatttaaaatggaaaccctgacaagaatgagtgtcacagggagtaatgaattcatgatggaactagttgggagtgtgtgacattttaagtgcctcatcactctgaattcactgggcatttattgtaatagaaaggaccatattgaattcatttggcattcatgtggacttcacatgtatttatggagatgtaacatggtaatttaatatttattctactaagcattctttaatggacattgaaagatattgtcatacaatgcttagtaaagccggtaactctaacgttattcttctatcaaaacaaagaaatgaaacaccattttgattcccaaagcacccgagtaagttatttggataagccaacattatgtatttactcccccaaatctgctttctaaatttttaagccacaaggttgactctaggaccaagacaataaagcagaagttcagtttaggattctttatattctaaaattgtctgcaaatacattaatctcagtctaaaaatattaggggaagattttcttggaacatcagcagtaaatttaacacatggcatgccttcaatagatttctcttcttccccctttagagttcagtttgctgtcttcatcacagtcccaaaaaatacatttgtgtttcttccttgaagaagaattatttttagaacaaacacatcattatttgggaacaatcaaaagatcaaaggcataagaatctttgctggaaagtgaaggaagagttcttcaaccaaccaaaatgacaatcttttatttttattctaagaacagagttgttccaggacacagcctaatgcaaactctgctactagtcactttcaaaatgttgtctagaatgccttgtttttaaattttctctcagttgccttctttacaccactcaaaagcagaacctttattacaaacacaccaaaaggtaccatataactaatcttcctggtttgaatgtaaccaatgttcaaatatgattgtagagtattaattattttgacatcaatttactgaacacattttaatgaggaccagaaggaaagacaaagtttacttactttcgtgatatatatctggtccagaccttgtaagtaatagcactttcaaacttactatagaaaattcagtgactgtaaacatctttcaactctacattgtgagagagttttcaaatctttggcaaattaccctgtgtaaacctccttatgacccaaagagatattttgaatgaggggatgtattagtttcttagggctgacatgaaaaagtactgggtgacttaaaacagaaactacttgtctcatagctctggaagctagaagtctgaaatcaaagtgctgtcaagggccacactactttcagagtgtctaggggaggattcggcctcaccttttttaggttctggcagccccaggtgttccttggcttgtagctgaatcactgcaatctctgctttgttcctcacacagtgttctccctgcgtctctgtcttcacatggcattttcttatatggaccccacgcatactggaataggtccactctaacggcttcctcttaactcgatgacatgtgcacagattctattcccaaataaggtcacttttgcagattccaggggttaggagttggacgtttcttttagggggacacaattcaacccctaaatggggatctcctgacagttcttaatagggtcaatatttcaatgcgtgcatttgttttttataatgatcttttctatgatactgggtgagataaaaaccaacttatttgcctttaagagcttctttgttttctgccatttgtgctagcaacagtcagagaaaactttttttttatagcaaattgtttttctcaacacattctgtctggaaaagaatgttctctagttaccacctctttggtctaagggcatctccttggtttctgtgttacagcctctttgtgttaattataagttgctttgctttacagactcaaaatgaatgttacagtgactgataaaagccaggatcctgagttcaagatcctgaccaattgggtgcttcatttgaaatcagaatctgtgttcactgtggtttacttggggtatgtgttagatttctcttggttgcaagcaaaaggaattcacaatggttagtatcaagcaggtaagaaaagggaagaaagaagattgttgaggtgtgtcttagttcactagggctcctataacaaagtgccacaaactgggtggcttaaacaaaataaatttcctgtcaatctcttctagaggctggaagtctaaggtcaaggtgtaggtagggctggtttcttctgagggctgtgaggggaatctgttcatgcctctctcagcttctggaggtttgctagaaacctttggcattccttagcttatagccgcatcatcccaatctcaaccttccctttgcatgccagtctccctgtgtctatgtctgcctctgagtccaaatctcccattttttttggtaaggacgtggtatggtttggctgtgtccccacccaaatctcatcttgaattgtagctcccataattcccacgtgttatgggagggactgggtgggagataattgaatcatgggggtggtttctaccatactgttcttgtggtagtgagtaagtctcaggagatctgatggttttagaagtggtctccctattcgcttggttctcattctctttttcacttgctgctgatgtaagatgtgcctttcgcctttcaccatgattgtgaggcctctccagccacgtgtaactgtgagtccattaaacatctttttctttataaacatgtctttatcagcattgtgaaaatggactaatacaggataccagtgatactggattaaggtctacccatgactttattttaacttgattacctctgtaaagaccctatctccaaataaagtcactgagagttagaactcccacatcttttttttttttttttttggtggtggttggcgaggacagtgaaacccacagcagtgagagagttgtatgcacatggacacaaaagagcatctgatcataaagagaaggaaaccaaacctgtctgggcactgcaatgtgtgaatctagaactctccaactgctatgcttcagcttagatgttgcgcatcaccatatttctgtgtcctgaatttcacatcttcgagaagaattttattggtccagttgagcccagataccttcccttggctcaatcttcaatggccagggagtgagggcacaggtcacaatggccatgttttgagggatgtgcaagtttgtgtgtgtgcttgtgtacatgtgtgaggattttgtcctctacaaaagtcagtggaatcattgtgagactgtgagctggcaagaggatatctccttcccccacatccctcaccccatcccaatctctggagaggaaagactgcctgtgctctcaaagaagaagtggcttttcattgattcagaaagaaatgtcagttgatatctgcttcctataaggtgttctgtcctgagctggaggtatagatacaagaaatgggtcctgatattcagctattggcatgggtaagactgaagtaggaaaggacttttcatctcctcccaagccgaggacacagctcaccatgaggtcgttgggtacgctggcttcatctaaaagaaccacatttaggttcttatgcgagaccacggcatgagctcagtccatggcaatgagtcctattttgttgagatgcccaagcaggagtttccttactgccagcatctacagggctgccatgtgctccccacaactctcccaggcttggctcaagtgcagggaggcccaggtaactccaaagagagggtccattcatcatggacccaggctttctctgatgtccataactgtctccccctggggattttgatgaatattcaaggacataaattcacacacgggctcagctgttgtacacccatgggaatcaggaggctcagtatatcttcctaagtgttccatttctttcccaggagccacagaagtgcaacaaagagatgagccccataaaccactgcatgtgtgtgtttgtcatttttctttagtgcaaggtttacaagactccctcccaacagggtcgtcatctcaacacatgtcacttggctatacgcttcactggaacattgtgttgtgctggggctgaattaaatgtgcaattactgcacattttctcgaaaggagttttgacaatgataaatgcatagacatttttccacactcagacaacgtgactccttgctcatcaagtggctcaggattcactttgaagaactggtctcttgttaacaggagaacgtgggtgctgcccgagaagcgcatgggcctgagttcaagtgccacttctacctgtcatgtaccatctgagcgtgggcagctttcttactcctgctagcccgagttttcaatgagcaatcattgcacctctgataaacctcattggctatggtatttctatatgcaaagctgagacaacacttggaaagtaattaccatagtccctggttaatagtaagctttcaatgagtgttggctagcattcatgcccgtaagttatcctcttgcctagagcagtgatggctctaatgtgagttcagatccctacaataggagaaacagtgcttgttgcttttcaaaaagcagagaataaccataacttttctacagatccttgaatataataacagtagctaatatctgtttacttattacctgctaggcaatgtgatcaattttctgtggatcagatgattcaattctcatacaaaccctgtgaactttttggtatttattttacatattaggaatcctggtgggccaactgcagcccactggcccctccaggtccactgtccaccattctctactctctggtgccacaagatgcttatctgtatgaagccttaggaaggaaaccagaagaactgacaccctgtcttgttctccctccacctctgattcctcactagtgcttctaatttactgaagccagctggaaaccagaagacaaggctgccaggtgctctgacaaaggacggagcagggtatagaagggagagtaaattcagaggactaagcaaatgtactcagcacatctgcttgtgaacatactgccagcaagtgccatttgttttaagcgatagagaattagatatcctctttgctgtactgttccaaactgcttatttctttctccttctttttcctcatagactatgatcttttgatattatagcaggaaacttggcgtgggctagcatcttggtgtaatccaacctctcttagatttgtggatatttcattgtgaaaaggtcaagataaaaaatacattactaaatatccatttatcctttattttctcatcatatacagaaaggttattgccaaatatggccataaaggttttattgctccaatttttatagcaaaaacagatacacttcttaatgaattttggtttattagatcaccagtgaccaacatggggtttctagctcttaggagaccctgatggtggcaatgaaggtctgcaagctattttaaatatttcagaaaatctaatataatcttacttttacaaatgataaagcttcacaaacaaaaacatcaagatgttttgcttttgactgaaatgatattagctctgcatggtgaacttagtaatttaattctgatcagcagctctggttggcagttatatgtgcctttgattaataaaacatgggtgagaaaataaattattacttaatctgtgcagtttgctagataaagtctttgaaaacctggagtcaattggatggaaaataatgaactgggtgctcagtggtgaaataataagcacaataccagcttggcatgtctcacatatgtaggaaagccaagacaggcttccagatgggccgagatctgataaacaattccagtcaattatttgtttttagtaataacaacgacaataataatgatgatagtaggtaacaattattaagtggccagacatagtgctgaaatgctctgcatgtaatattttatttcttccttccaatagacctaggaggaatgcactctgattatcccttatttcaggttggtctccttcagaagcagactcagacatttatgggctcagatagtttatttgggaggtaatgccaagaagcactgtagggaatgaagaaagtcagctggggaaggcaaggaaggcaacaccaggatgcactgaatggtagattgtctctgtgggcacctgggatgccaccccccttggcacgtctggggacagtgtagaacacacctttgagttgtaccacacaatcagtgaggaagctgggtattgctcttccgactcctgtttgtaattagttcagagctgctttcagggaagtcgacttcccggaacttccagttcaccctgtggaagggaaggggctgagcatgttctggtggctagagaaagccctcaggtacagagatacaggggtttccagaaagcctctggtgacgcacaaggatgtgagcacacaagaacagtacctgctgcacttccgtcctacaagagaggaagtcaagaattcatgagttgaaataacttatccagagtcacaaagcgcttgtgatggtgtgctcttccaaagaatttttttgctccctgtgtctgaaggctaccaatgtccaataatgtaccaaatgagcccttgttcttagagtttttttaaacaacagctttattgagatataattcacataccatactattcactcttttaaagtgtagcactccatggttttcagtctattcacagaattgtgcaaccgtcgccacaatgaactttagaatattttttaaatctcctggaaaaaaaaaaaaacactatcctgagtcatacctcattttccaccattatatcctcagctcctggcagccacaaaatctcattctgtctctgtttcattcccttttatggacattttatagaaactgaatataatatctgatcttttgtgcctgccttctttcacttaggatagtgttttaaatgttcatccctgttgtagcgtgtatcaatacttcagtctttgcattgccaaataatattccattgcctggatatatcacatttgtttatccacttattgctcaatgaacattttagttgtttccactttggggcgattttgaataacgttgctgtgaaaatatgcctataatctttggtgtggatatgcacctacctaggattagaattgctaggttatcggcaactctatttttaaccttttgaggaactgccagattctttttccaagcagtcttagagtttattgatgattttaatttgctgtttaattaagcaagatgcctgccttacactgtttggcaaaggagaaaaatcagcatcaggcacttgcagacatagatttccagaattcctaaaacattcaagaaggatgttatcggtacatgatcagagttgagtaggttctggattttaatgcctgtacttgctttttacttataaatgattaatactttagcttcataattatccatttagtttatgattatgggttgcctggttaaccctactgggtgtagtgatgcatgctttcatcagaaacatttttggcctgcagtttctaagtagccagattttaaagcatatacaggtggcagttcattaaacatgcattcgtttttgtttttatttggcacctactgtgaatcagtcactgtgttaggtgctgtgaatacagtggggggacaaaaacagatacaattgtgttagagaaaaataaactttgaaggaaactgcactagaagatacagcatttagtcattgctgggattctcttcattgcaagcagctactgcattccgattattcaccctgaatctaaggcaagctctgctctaaaatgtcacacaagaaagaagtggaaaacctcttctccaggaggggtttgcaatgtaaataaagagacaaagaatgccttaggtgtttcctctacctagcataatcaaatactactatgaaatatgcaagagtctgtgtcatcactgacattcagtcttggatttattttttttaactctgtgtactagacactgcctcttggatgtcccatagttcattgaactctccaagtgcaaagttaaactcaatctccccaccaacctctaacctcaacccagccccagacttttttttccagtgtatgctttctattttagcaaatcaagggtgctactcaccgtgctgttgccaaaaccacaaacatgggcatgattctcggtgtttctgtaggcttctctcacctaccctctagtcaggcaggtcttcatcatttaaccttctacttctctctgacagatttgcttctgtctatcctcatcttcatcctagatctaaaccaccattatctcttgcctgcaaccttttattcctaattctagtctttaatatctaatttctgctccaaatggcagctgaaggattattttcaagctcagatgtatcctgccacaccctttggaactcctcatggatcgttattacccccaggtttaagtccattttctttaacatatcagagccttgctccaaatggcagctgaaggattattttcaagctcaggtatatcctgccacaccctttggaactcctcttggatcatcattacccccgagtttaagtccattttctttaatacagcagcgcctgtccttcatgacccagcccctgatgccatctctggttttatctttacccactcccttagcagatgcttgtgttgagcagagccaaaccaaatctcttactatccctagaatgtgccaggttctttcacattggaaagtttgcataagatgagctttgaaaagtactttttcaataacttgtgtctcagtggatttctattaattaggatatgggtttggatgccatagcaaagattcaaatgtcagtggcttcaataagatagatgcatattactctctcaagtgatggttcaggcaggagcagttctagattgacatggtggccccactgtgtcacttagagacaaagtggagacaggggtggagagacataaatctatctgagagatgtgtaggaagctgaatctttaaaacctggcttccctcttattttatggcatttgtggaatgtatcctgtgtcctcatggccccagacaactcaccaccacatccacattctatcccagtcagtgggaaaggggaaaggggagccatatcccttctcttgaaatacacaagtggaaagttgcatctaccacctctcctcatatcttcttggcgagctgttgaccatatgactaaatctagctgcaaggaaaatcaagagctattggtctttctttgggggacaaatagaagtttctggtaattattttatgtaaaactaatccgaagaaataagtacattttccttccaaacatggcaatcctggcagggttgtgggcactggaatcacaccattttttgctaactaaacaaatttccaagtcaacaatgtcagatattggaagttcaagatagataaaggccactagtatgttggcaatagcatgccctctttacaaatgataaaatttagagaagtcaggtgcctcccaagtacccataacatgtacacgcccccctgctatcttctgaatccaccctctgtgctgaacaaacatgcagggcagtatactttagtgattaagaacaccagctttggactcagaaaggtctggatgcataatcacttattattgtgatatttacaaattccctaagttttctgagctttattttcccacaaggatgttatatgcattaaatgggataatatctagaaattacctaggaaatatctggccaatgattagcacttaagaaatgatctctagtataactataatgaatatctcttaaactttttctgctatgaccagttattgcttcttttggagacatgatagctggaaaatgtgcactcataattttgccagtgtttatttcttcataaggcaagacaaaaggagtcctgtggaagacgcctcttcactttcttcttaatgtacttggtctaaggtatccacacttgtctgagagatggcagaggtgggtgaggcaccacagctctgtctttctcttagtaaactcacagattcctaactaagtactcagagtctgctgtgtgccatacctaacctaaaatcccaattctacccattcctggctgtcagatcttggaaaagattcttgacctctcttagcaccaacctctgcttctaaaaatgagaataacttgaatacctacttaacaattgtcctcggaggaatagctgagacgcttcacctagaagtgcttaaaactgtgtctgatatatcgttcatgcttgataaatatgagctgacttaaattcccccatttaagcatgaatttcagcagaggcagtaggggtaaaaaggagaggatgcggtgaagaaaaatttagaaggcataatggaaaggacccagtgatggtccagtgtcagggagatggcccagatagaaatgtagcaaaattatcctgaaaaatttgattatttgatagaatggttcaccaagatggaaaacacagtcggggaggagagggcttgagaggaagacaatgagtaaaacgttaggcatggtcaatttgagtggtcaagggattcaccatggagatattaaacaggcattagatagccaggtctgaagctctgtagagaagtgtaagttcaaaacattcatttaggagtcacttgacccaggaggcaccagccgcaggtcacaggctccattgtcttcagggaccagtagcagtcatgtgaaaagcaggaaagagagacggttaacttggggtcaacaatgcgatgcacgccctgcccaaaggccttcaagtgcattcacctgggtgagtactcagcctgaggtctgaatggaaccttccacctgggaagatgttaaagtggttatgaacgaatgaaatctacccccaaggttttcctggtgcagaaagagaagactgaagatcaaatttacaacgtgcttagacttctacagtgttgctgaaatctacatcagacagtattttggcgaggagcaaggcttccccagcagtgttcatgatctgacagctgtaaccaatacctgacatttcccttttggatataaataattatctttcacagttatggcacatacacaacaagtaaatttccccttttatttggaaagcctctactttacaattcatgtttaccttcctgaatcttttctacatttcaaattcatgttttgtttaaaaagatgacagacacaggaaagcgttggttatggcaatataattaaaggacattcatttcactcaaacctgcatggtgatttttggcaggggagggggctggcaaatgatgttttgcctcctgtattagttttctatttcttctgtaaaaatttatgacaaaatttgtggcttaaagcaacccatggatgtctgaatggctttggttcctttctggaggcccaagggcagaatccactttcttccctctcccagtttctagaggctcacagccccttccttcattttcaaagccacaaaagttggatctctccagccattttctgagtagttacatctcctttgcactcttttcgacctccatctctaattttcaggacccttgtgattgcattgggttcacctgggtaagtgagaagactctttttaaggtcagctgattaacaacccaaattccacctgcataggttctgtttgccatataagtttataagttcctttatatctccgagtagtactgcgtggcatggatgtaccacacggttgttgttgtttttaaccctctacctgctgaaagacatctggtttgcttccagttttagcatttatgagtacggcagctatgcacaattgtgtacagatttttcttttaatggaggttttcattctctgagatgaattcgcccaaaagtgcaatgtctgggttatataattgcatgtgttgttttattttttaaaaaaacattgctaaactgttttccagagcggctataccattttacattctattgaagagttttgagcagtaaggtgatgcaatcctattcatgttttaaaaacattctctggatgatggatcaagaatgccagtagggagggcaaatgcagaagcagggagatcagaagggagcctctgcagtggttcaggtgagaggtgagagagagagtcaaagcatgggtgggtgtggctgagatgatgagaagcagtaggataagggacatatattgatgatataattgacagttgctgcagaattgtttgtggaaattgggagaaaagattcaaggaggatttctgtgctttgggcttgaggatggtggttcatgatggacctatttgtcttgataatgggaggacaggggtgggagctgacatgggaaagagatgagtgcctgttaaattctacagtggaaatcttgagtgggtggttagaaataagagtctggagccaaggggagatgtgggaagctggagagaaagtggaaaaggactatgtctataaatatgcccgatgcaaagcgtggcatagtcacaggcaaaagctatccacttgatctcaagaacaatcttttttcaccttctgggcttcacaaacaaaatagcaccttcagtttccatttcggtatagcaggtacggtaaccacaagaacgtgcaaagcagaaacaaagagcacttggcacccaagtcttatagaggctcatttctgatatcttctagggaacttctttgtataaggacgtcatagagaaggtttgtctttcatttgtctgtagcaaggtcgtaattttttttaatctttaaaaaaaattattgttaatacaaataagtctattgtgatttttaattctaggaagaatgccatacaaatcttttttagtacacgtttctgttttatactgtgatttggaggggtaaaaagggtaatacaaaatatggatagttttttcattgctggaatgttccacattgggttctgccttggcaacgtctcctgtgagctacagttgagggccaaagcagatgctccgtttttatgcatctgtcgatagccacatgactctgcaactgccactgcctccccacaccccctgagctggcgccagcacggagcagctgaatccgactcaggcttcatcccagctcacattccaccttcccgacaaggacactgaggcccagagatgaagtgggacttcccaccacaagtcaatgaggagatggggtagccaggcctaaaaccccggcctttggcttacagccgcccgtcattttcccaggtgcccacctcagaggccatccttggaaaaggaaacgtcactaacctatggttctggggaaatggagacgagagaggaagtaatatgttgttcttcttttctttaggcttctttccactgggtaaatcttctccatacataataaaatgaaggccccagatgatttgtgaaagagttgaaatgaacttcctgcaattgaacaaactattatgaagcccctactgtctttatcagcaattcacagtcttttgtccataagaataagcaggggacttaaaaaaaaaaaaaaaaaaaaaaaactactggtacttgggccttaccccagactaactaaattagaccctctagggtggactttgctctcagtatttttcaaagttacccatgctattccaacgtacagccaggaatgagaacaaactggtctatggtactgtgctaattgatcctgtctttggttctcaagttggggtgatttggcctctgcagaggataaaaggaaatgtctggagacttttggttgtcaccgttgggatgggggctgccgttggcttctagtgggtagaggtcagtgatgctttttaacctcctacaatgcactagacaacctccaccacaaagaattatctggccccaaacatcgatagtgccaaggtggagaaaccctaggcttatggatgccatgggaaacaccagttacctggatgtaaatccatggtaaaataacatagatgctatgacatgtggcccactggaagacacccatgtcaaatcccaggagccagtgaatgtgagcttatttggcaaaagagtctttgcagaggtaattaagttgggggtcttgagatcaaataatcctgaattatctgagcgtatcctaaattgaatttcaagtggccttgtaagagtcatagaggaaaacagatacacaggggagagggtgatataaccatagaggcagaaattacagcaatatggccccaagccaaggattcccagagccaccaggaggtggatgaagcaaggaaggatccttttttagagacttccaaaaaagcgtggccctgctgacaccttgatttaggtcttctggcctccagaggtatgagagaataaatccctattgtttttttgccacaaggtttgtagtaatttggtatggcagcaataggaaaccgatcagatgcctgtgcctttgtttgcaaaattcaacaaagcacattaggagagatggggtccatgagaagggataggatgcatgcaactcataaggctgaagacagacgggagtgggagtaggaaggtctagaagagaatctgacaaagatgcgggtgaaactctgaacccctggccagggcagggaagtcatgaaggccaagcaacacatccagtgatgattcttctgtcgacatttcatttctgaaaactggttgtttcattaaattttttggtttttcagatctcaaggtgtcagtatcttgtaacagtaatgagcttgattcgctgtgaaaagcaagacgtgtgaaatagaaacaaacttaaacttttaataatttcatttactaatggtcactaatgacctagaacccaagacacatatctttaaaaaaattagattagggaaatgatatataagcaaaataataatttagtaaaaggtgtaattatttttcttccttttgtaaaagttatttgtaattaacaaatgatcatttgtatatttttctagtaacacctaaaacttcctgatctttatccgtttaaccaacatgtatggtgttaaagaaacaggccaggtgtggtggctcacacctgtaatcccagcagtttgggaggctgaggcgggcagatcacctgaggtcaggagttgaagaccagcctggccaacatggtgaaaccccatctctactaaaaatacaaaaaaaaaaaaaattgccaggtgtggtggtgggcacctgtaatcccagctactagggaggctgaggcagaagaatcgcttgaacctgagaggcagaagttgtggtggaccaagaatgcaccattgcactccagcctgggcaacaagagtgaaactctgtctcaaagaaaagaaaagaaataactggaaagaaagtaccagcaaggaacgtcctttctcaatacctcttacatgatccctgtcccctacgtcctatggtttcaccgtatcacatcctcacacactcccctctaactccactttttaagtgactctgtttcctcttacattttcccatagtctgtcttccccttatataactgtcattatataactcattctgtaatgatttacttaaacctgacttccccattaggaagtatgctccatggggagagagcgcatatctgcttcgtatttcccccctaaatcctcaacacctgttacaattcccagtgtacagtaagcagtccataaagctggatgattactctgcatgtgttagtgacatgcatgaagtacccatttccccttggcacgggaagcccaggggaacagcattttcctgcctgacttctgaagccctcatactcatgatcctacgggagcaatggcaagggcaccggaaagccaggtcggagaatagagacccccagcctgctctcacagttggactcagcagtgcaacatcagtgactcctttgtgggagtcccacacaccgctgttcacacagggaacaccagtgcccggtggagctgcgggcttttgagacctcccgagtcgctttgtgtgcacaatgccgtgactctggatttgtacagtatgaccctcagacgctggaacaggagcacacgccaaagagaaaaaggagtggagatcactgagatctcataaatccataatgggcctgctctgtattaataaaacaatctcaatggtggagctccataaaagagaggcataggctgatgtaatttccttgaagtcccctgtaaagcattttactctgtaatacagctacatttatgaagtggttttatcttgaaagatcccaaagggcttactagactgaaaaggaaaatatcaagtacacgacatctcaaaacaccaccaatgtacttcggtgataacagttggggattctgtgacagcaggtagccctcttaaaaagcagacagcggcttagcccattaaacctccagggagaagtaaagagaaagaggagataattgtccacattggataagggccacacaggttttctttattaataaaggccatggcttgtttccatccgccacgtggatttaagtgggtgagctttatcaacatcattctccttatttgaaataaaagaaagaaaccaacttataacacttcttcataaagggactgagaaaatatatgtaaagcttccagtggttaatagaggtcaggtgtagccagtgtaatttagaagctgtgcattttaaaaagtaaaatataacctacagttataaaatatatccgacaggaaaaatatcttttcccagccaaattttactgaatccagtcctgtcgaaatgactgatcctgggtttttttcttccttgttgctgtcctggttaggacatggtggcactaacttttagtgaattagccgaggatataggggaatggttggcaggggccagaagtccttcttgattatcctccaagaatatcaccccactgggagctaagaaggaaggtggaagcaccaggtgatgtaagtttagcaatcgctgagtactgtcaaagaaagcagtctgagacttcaaagtaaataaaaagtagctcccctttcttcaaaaatgttaaaactgatccactctctaaccaggaatactgttgtctcacattccctctgcagtttctctcatcccacttctgcttccagcccaaacccctcacccgtctcgttttcccaccagaaagtactccttgtctttttactaatactttgcttcttccctccccacacgatctctccaaagcctgggaactgagctagcaaagagaatgctcttctgagcttggagctgaacaaggagcccctatggaggagacaaagatgcaaaatttttagtttggttttattctcatttaagttttctatggagtatttttcttgtgatttaatctttggatgagactatcaatgtacgtttcttctaattttatttttcaaatattccattgcaaacttatttagcatttataattgaatactgataagtgaatttatttattcatttatttattcatttattttgagatgcagtctcactctgccacccaagctggagtacagtggtgtgatcttggctcactgcaacctctacttccaggttcaagggattctcctgccatggccagtattattttttaaatttttagtagtgacggggtttcaccgtgttggccaggctggtctcaaactactgacctcaagtgatctgccagcctcagtctcccaaagtgctgggattacaggcatgagccactgctcccggccagtaaactttattttattttaaaaacctgttttggagtattagcccactggtttacattgtcttccttacatacatcacacccatatggaggagtactttaaagacaaagttgcaatctggtagcatagctgcccagtggagaaaaagtgcacatgtaaagcctgagtaattcagggcatgaaaatatccctgtcagccaatcagtcaacgagttgaccaagcgtcttggctagcctcagaggtaccttggcaggcaggctcaggcattgtgcagccctgtgtaaaattttcctcatagtaactacgttgtctttacatcaacctgagaagtagatactatttttcctatttttgtttgtttgtttgtttgtttgagacaaagactcggtctgtcgcccaggctggagtgcagtggtgcgatctcggcccatggcaacctccgcctcccgggttgacgccattctcctgcctcagcctcccgagtagctgggactacaggcgcccgccaccacgcccagctaatttttttgtatttttagtagagatggggtttcactgttggctaggatggtctcgatttcctgacctcgtgatccgcccacctccgcctcccaaagtgttgggattacaggcgtgagccagcgcgcctggcctatttttcctattttattaatgagaaaactgaggctcagagatgctaaataacatatctgagttcatcactgccagtcaatctgggctcaaacattccgatccagattgctctgattctagagcctttgttctggaaatctgtcttttataatacacagggattttatttttaaccttttattttgaaatgaattcagacttacaggaaagttgcaaaaagaatgtaggtaattcctttatatttttagttcaaatttttcaaatgttaacatattatcacatttacttaatgattcctccctcccccaactattgaagagaaaattgcagactcgatgccccttttcccctcatcttcagtgtgatatttcccaaaaacaaggatgttttttctctctcatagaatcacagaacaatgatcaaatcagcaaattaacgctattaaaaattatctaatcaacacacttaatttggatttatccaattaccgcactaatgtttttttattgcaaaagaaaatattttggcccaggatctaatccaggatttaatattgcctcagatctcatgtctctttaggttcctttaatctggaaaagttcttcatctttgttctgtctttcgtgaccatgacatagttgaagattataggttggttagtttgttcggtgtctcccatgattagatccaggttaaagaaacagctggaaagaaagtacaagcaaggaacttcctatgtcaacacctaaataatctctgccacccccacccccatggctttaccccatcacatcctcacaaactcccctctacctccacattttaggtgattctctttcctcttacattttctcatagtctgccctccctttatagctctaatcacaacttgaattgtataacaaattctataatgatttttttaaaactgacttccccattagggtgtatgctccctggggactgagctcatacctggttcgtatttgcgcccgctgaatcctcaacacctagtacaattctcagtaagcagtccctaaagctaagtgattactctgtatgtgttagtgaaatgcattaagtgcccatttccccttggcgtgggaagcccacaggaacagcattttcctgccttacttctgaagtccttgaactcacgctcctactggagtgatggcaaggccactggaaagccaggtcggagaacagagacccccccagcctgctttcacagttggttccggcagttgttgcatttgtggcaagaacctcatggcagtattgtgtccttcacagtgctttgtatcaggcagcatgtagcaggcttttgtgtccttactggtgacattaacttggaccacttacagagggtggtgtctgccaggtttctcctatataaacttaatttttcctcctttgtaactaacaagggtcttggaaggagatatttccagactacacaaataccttgtttcttttcatattttcacccactgattctaggcttctttgataatttttgccctcctgccccaccaaaaaatattttaccattatggttaccaaatggcgattctctaatggcatgagtccttctacatttatttgttggcattctattttaaggaaaagctccccccaacttaagaatttatttccaattttaaaagtttcattactatggttttatgggttctttttttattctgtagggtaacaatctgttgctacccttatttattcttgtgcgccaattgtccaccgtttgtccagtgggaagcctaacatgcagtttttatattcaagtatcctagcacgtcaacttttattgcttcacttaaaatctgccaccttccaccttcatgtcctgaatcctttatctagaaaatgtgtaattttccaagaaggcctcagacctagtggtccagttactgtctgtttttgctgactaactcttgaaataagaatttttttaaaagctggtagtagggatgaagggggttaagtgacagttctcctaagaagcatactcatggccctgccagcggcttggagacataagggaggtaaactgaaatctttcctgaacacttcatgctttttggtttctctccactttttaacacactgcagtgtaattccctccactatcctgaaaacatggatttagattccaagacccatctctccttctgtgaagccatcctccctgccccacccaggcaggatgaattattctcttcttggcagctctagaagccctggtataggcttttgttctagcatcagtcatatggtgttataactatttttgacactccgttcccctcaataggctgtgagcctttcacaaatgggtttttacatatatctgtgttaagtaataataaggctgggtgtagtggctcacgcctgtaatcccagcagtttgggaggctgagtggggatgattgcttgagctcaagagttcaagacaagcctggacaacatggaaaaaccccatctctacaaaatatacaaaaattagttgggcatggtaatcccagctgctcaggaggctgaggcaggagaatcgcttgaaccctggaggcagaagttgcagtaagccaagatcgcatcactgcactccagcctgggcaacagaatgagactctctctcaaacgaaaaagaaataataaacatttttaattatttaaaaatgtgttagaatcgatatctaggtcattgtgtaaaccaaaggccagcaaactttcctgcaaagggccaggtaggctttgtaggtgatatagtttctcttataactagtaaactctgctactgtatatctaatggccctatacacgatacataaaagaatgaatgtggctgtgtttcaatagaactttattcatataaatagacgtggggctgaattttaccctagggctataatttcctgacccctgatctctcccacctcaaggtcttcctattagctgaatacctgccttaggaaatccctcattttctctggctattttctgcatattctttttttttttttttttttaagcagctttctagcttctctctggaagagtggaaagatgatggggctagcccatagtttctcaacctgggcaatattgacaatttgaactaggtaatcttttgttgtgagggagtacattatagaatgttagcagcatgcctggcctctacacactggataccactagcagcactgcagtcatgacaatcaaaatgtctccggacatcgtaaaattacccctggttgaggagaatcaggctagtccgtgcacaatatatttttaaatttttctttagttcttcaagagccttccaggtgaaggaatggactgccacagccaaaaacaagatggctagcaaactcttctctccaggaaacgtcttcctaataaggcatattttattattttgtcagaaagtccatttctacacctttcttaatcctccatttagtatttctctttttttttttattatactttaagttctggggtacgtgtgcagaacttgtaggtttcttacgtaggtatacacgtgctatggtggtttgctgcatctgtcaatccgtcatctacattaggtatttctcctaatgctatccctcccctagacccctacccatcgacagtgtggtgtttccctccctgtttccttgtgttcttatcgttcacctcccactcaggaatgagaacatgtggtatttggttttctgttcttgtgttagtttgctgagaatgttggtttccagctacatccgtgatcctgcaaaagacaggaactcatccttttttatggctgcatagtattccctggtatatatgtgccacattttctttatccagtctatcattgatgggcatttgggttggtttcaagtctttgctattgtgaacagtgcatattcttttttttttttttttttttttttttttgagacggagtctcgctctgtcgcccaggccggactgcggactgcagtggcgcaatctcggctcactgcaagctccacttcccgggttcacgccattctcctgcctcagcctcccgagtagctgggactacaggcgcccgccaccgcgcccggctaattttttgtatttttagtagagacggggtttcaccttgttagccaggatggtctcaatctcctgacctcatgatccacccgcctcggcctcccaaagtgccagtgcatattcttaagggctcagcttaaaccttacctgtttgagtgtaaggcagagctccttgatctgcataatagattaagttccagtgctgtatttaccaaagtcccctctattatttccctattagagcattcattagtattaactataatgactataatgacttgttttacctttgaaattttattaaaattattgcaagagcacttttttaccttccaatgcccagtgcttcagtacttactcagagtgcaggcacatttaaaatatttgttgaatgtacaaataaatgtttaaaaggtttcacatagactaggttgcaaaatccatagcagacactgtaggtgctccacctatatcctttccttttaccattctggggcatactggcctaatttacttgcagaagaacaaacacattctgagaacagccaggcctcaaccaaagaccagcaggagcaggtgcataaataccccaactccctcacccttcgaatgcgatgactctaaggcttatgttttaaactggcttccataactcaccagcaggattcagttctagttatccacattgacagctgatttgataacagccgttttgttggctgctttccctgccttatctcatttcctattctcactgtcactctcattcctgttctcttattctcatgtagtgctcccatcaccttccacatcaaccccgcacacttgaatccttgttgcaaggtctgttcctaggacagcaaagcataaggtttccaacaaccctgtgagatgtgtatcatcacctgtattttaaaagtaagaagtgcagggcagagagattatggccatctaccaagtgcatcgaagaataggcatctaacccagacctctggctacaaactctggacatcatccagttcaccatgttgtttctataaggtgttcaactagtgtgcgttaaatgacaagatggctgggtgtagttctgatataaactcttcccaaattcaaccttgaattcaaatggtttctttctagtcgtagtatggtaccaaatagataagtctgtttaggtaagaattaaatgtaaaaaaacacaaacatttaagttcattggattgtttccccttaactgcctgtgccccttaaatgctaccttttcctgatcctatttgaggggggaagtatcttttgaatcccagacttgcagggacggattctgcatggcctgtacccttgtttgcagcgattactctgctcagaggaggatgacctgtgtggggagcctcttcagctacttgaggcactaaccctctagcccaggaagtcccattattgctgggccctgccataagcttatttgtatttcacagcgacttgcacagatgtgccagatatgtacagatggatttttatcagaagagagtctacccaagtgaagcagtgtagggtgaggctaaatcccaaaattgaaatttggggacactgattaggcacagagcaggaccaggggttaaaaccatgtgggaaacagatcaatagaatggaggaaaacagtccctgaggaggaccctatgacagaaatctactatagagaaacggcctgggcagaccaagcataatattcagtggagagtctgggtgtgagagctgtgtttgggtgagaagcagggaatgattgaaaggtaagacaagagaaaacatttccttttgttcattccatttctgcagaggctcttgtatttctgagtcccattttgaaagtcacacagcccagcatctcatctcttctttagccgaaaaacatactgcattagctgagtctccagagcaagttgttgctagccttgggacctggggaggttatttcagctgtgagtacctcacttccctcacatgcaaagtgcagtagtaacagcacttccatcctatggtagctgggacggaaaatgcataactccatgtgaattgccaaggatagtgcctgtcacgtggtaagcatttaacacatagtagctgtttttaatattatgtgtggtagattggcaccattccatgaatccaagccatttgggtatgataactgaactggttgtcaaagcaagaatcagccttgtgtttacaaccactgagaaagagcttgtcaagctcttagctgaaatctgtacaaaatatctgctgcaggtctctacctttttaccatttaaggtccatgaaggaaaccaggtcactcaggcacaacctgattttaatgaaccctcgtaggcgtctaaagaatcaccactttatttttttaaagtgttcaaaaccattactttaatgatttgttctggagtctcgacccagaacaatgtcagtctcgttacagaatctcagaatttactgccactttttgaaatagttggagatactttctatcctctgtctcagcatttctgccactcttctggattggatttatttagaacaattaaatgctgtcttacaatctctttccccaacttggggtttctcttcccttctaccaacgttcactctgcattttcattctgatgctcatttttcttggcattttgtctggagaagtttgaagcagagcagatgctcagacggtctgcatccctcctctttgccgtccttctcctttgctcacctgcaagaatcaggctttacgattcaactttctgttccaaacatagctttaaagcctgtttgggtgtccttagaaatttttctaagtgtcagctcatatgagacacccgctccagatgtcttgttttcccactgttcactgttcaatttaacaaaacacatattaggcacctactgtgaggcaggcattgtgctgctcttgaaagatacaaaggaaaacaaggtgtagtccctactttcaaggcgctcacggtaaagctagaaatgtaaacaaaccaacacaaaacagtgtgcaagaatcctgttaaagacctgccctcactgaactgtgcccctccacctggaggctgcagcgggtcaaggatggcttcactgaagggatgatatttgaacaagacttatttttatttctttttattcttctatcccatgacatttccttttctagtctcctaggcagccatcaacaaggtgcacaaatatgtctttttgcttatacagtagtcatacaaaatgcatgttgcagttttgtactcagctgtttcattgatgtaaatgatcctgtgtcacatactcacacaccttattttttgctttccctctctaagcatttttggtttttggttttttttgaaacagagttacccactgttgtccaggctggagtgcagtggtgtgatagctcactgcaacctctgcctccccggttctagcgattctcctgcctcagcctcccaagtaatccctgggattacgggcacccactaccatgcccagccaactgttttgtttgtttgtttttgtattttcagtagagacagggtttcagcacgttggccaggctgattttgaactcctgacctcaagtgatgctcccacctcggcctcacaaagtgctaggattacaggcgtgagccaccatgcccggcctaagctttctttgtaagatgcattcatgtcagggtgcaaacatccaggctgttatttccattcactgtgtgtccttgcatcttccacatccttcacttttccattgtctccatgtagaatgcccacattgtctctggttcccaacaccctgaataactgcagcaataccctttacgattcacatgcagatgggtgtaaaaggttccttggcttatatttgcccagaaatggaatttctggatcacaggtatgacaggcagaataatgaccccaatgatatccacattctaatacctagaaactgcaaatatgtgaccttgggtggcaaaagggactttgcagatgtaattagattaaaatttttgagattgagagatcatgttggacgatgtaagtgggcccagtataatcacaagggtccttatcagaaaaaggaggaggcagaagatccagagttggagagagatttaaagatgctctattgctgtctttgaagatagaggaaggggccaggagtcaaggaaagtgggcagcatgtagaacatgtaaaagaaaaggaagcagatttgtccctagagccttcaagagtctccatgtcagacttttgacctcaaggactataaaataatacatttgtgttgctttaagccattaagttcctggggatttgttacagcggccgcaggatgcccacacataaactacgcccagactgactttgactgtaatggcgctgggtcagtctcagaatggctgtccaggcccacatttctgatagccgcacatgaagtcctcacgtctgcacaccctcggcatcacttggcccaactcgtctttctgatttctttcagtccgatgggtataaagcataaacaagtcttgaataaagagtcagaattccttccaataaagtagggtggttgaggtgagatgggggatggccttggggccctggctgctgtggttggatggtctggtctttgggagaggatgcacaaatcattaggaaagcagagataaggctcccaaggggctacatggagagtaagtggagacaaaacccgtgcgccttgtgaggacacagggctgtgtggactccatggaagagagggccccagacagtggcaggcagtgtggggtcacagtcgtagtcaggcctgggtgtcagtcacagttctgcagctgccgtgtgaccctaggcatgctcttaacctctctgatccttggcatccttctccctgtgacagggataataatactatctgctcataggactgccatgtggcttacatgagatcatgcatgcaaagcccctaatacagtgaatggtatagagttggcacccaacaaataatcatcgtaatgatactattttcattagcacaataattgtaataataattacagtttcttacattcctcaactccaagaaaattggatttttcttgtaatctgcaggatccattgctgaccttgctcttctatctggagaataatgtattgcaatcagtttccacatatttatatgcaaaggcctttatatattattttcaaggagatcttcccctccttaaccattgcccttgtctatacccccatccctgaaaaatgggggtttccttttagggcttttaacagcataatgcagttgaatacaacttattttactgacatctctcctccaagcgctctcccccagcactttccaggactaaataatgcatgaagggagagaataacagggattgcataaacgacggaaaacagcacggtaaggattctgtgttgtgaagagatgaaagcccctggtcagaaggccagtaacaaagcaaagaagaaatgcaaaggcattgacgagggagacaagaaaagtatttttcaagataagatttgtggagagttaaaaaggagatgactcaggagacagtcaaagactcttcattagacaggaactccagagtgggtacaccagggggcctgggcttttgaagggctggggctctgaagaagttaacaaacaccagctccacttcctgggcctctgaagccttctttgacgtgcccaggtgggggccgattcttcttgcttggtgtcctatgcctccctcttcctacctttattagagaatgtatctcactcaactgtaacggtggattcctatgtcctttttcttcactgtgctggagctccaggcgcttttccagttatcctcatgcttttccatcttagatgcttttccagttatcctcatcatagattaaaataataattgttggtcatttagtctgtccctgtgctaagtgctccatgtgcattagataaattatgcctcaagacagccccagatacccattttacaactgtagaaactgaggcaggaggagattgagacttgcttgcagatgtgcaaatggtggagaatgtaggtgagattggcactgaggggttcagactcccaaatagggctgttgagtttcttttactcccaaaaccaagcacagtgctgagcacgaaaatgcactaagcaagagtttgatttgtgaacacattattctgcctggaactcagctagctagccaggtggtactcggagttggcatttctgttgctcaggccgggctgcatttggtgagttgcgggaaggggatgatgacatcttctccagttgacaaaagacaatggcttgttctgaggagagggcctggaactcttggtccatcagtctggctttgtcctgtctattatacacagtctaatcacccccaacaaatggtgctaggaaaacgaaaacaaaagctatatatttcctcttatagaatttttaaaacaactaaatatacctctggaatacactttacaaatttatgctaaaggcttccacaccaatgtggctcctaagttcccaaaattgagctccattttgaattgcccttggccctgctctctctgggattgctagagagttccagcatggacccagtgtcctttgtgggctgcagagctggacaacactgggatgagtaaggcagccaaccctcagccctgggaggcacagtgagggccagggtattaaccagaagcttagtagtcattttaccatcagcattaagtcacccacatgcacactgatatggtttggctgtgtccccacccaaatctcatcttgaattgtagttcccataatccccacgtgtaatgggaggaacctagtgggaggtaatttaattatgagtgagttctcacgagatgtgatggttttatatggggcttttcccccttttgcttggcacttccccttgctgccaccatgtgaagaaggacatgtttgtttccccatccaccatgattgtaaatttcctgagaactcccagacctgcagaaccgtgagtcaattgaacctctttcctttataaattacccagtctcaggtatgtctttattagcagcataaaaatggactaatacagcaaattggttctgagggagcagggtgctgctctaaagatacccaaaaatgtggaagtgactttggaactgggtaacaggcagaggtaggaacagtttggagggctcagaagaagacaggaaaatgtgggcaattttggaacttcctagagacctggaaggctcagaagacaggaagatgtgggagtttagaacttcctagagatttgttgaatgtctttgaccaaaatgctgatagtgatatggacaatgaagtccaagttggggtggtctcaaatgaagatgaggaacttgttggaaactggagcaaaggtgactctcgttatgttttagcacagggactggtggcattttcccctgccctagagatctctggcactttgaactggagagagatgatttagggtatctggcagaataaatctccaagcagcagagccttcaagaggtggcttgggtgctgttaaaagtattcagttttatgtattcataaagacatggtttggaattggaacttatgtttaaaagggaagcagaacataaaagttcagaaaatttgtagcctgacaatgcaatagaaaagaaaaacctattttatggggagaaattcaaggctgttgcagaaatttgcatcagtaatgaggagcaaaatattaatcaccaagacaacagggaaaatgtctccagggcatgtcaggggtcttcatggcagcccctcccattgcaggcctggaggccttggaggaaaaaatggctttgtgggccaggcccaagtctcccctgctttgtgcagcatgggaacttggtgccctgtgtcccagccactacagccatagctaaaagaggccaaggtacagctcaggttgtggcttcggtgggtgcaagccccaagccttggcagcttccacatagtgttgagcctgcaggtacacagaagtcagtaattgaggtttgggaacctctgtctagatttcagaggatgtgtggaaacacgtgatgtccaggcagaagtttgctgcagggacagaacactcatggagaacctctgctagagcagtgcagaagggaaatatggggttggagcccccacacagagtccccactggggcactgcttagtggagctgtgagaagagggtcaccatcctccataccccaaaatggtagctccaccgacagcttgcaccaccatgcacctggaaaagccacagacactcaaagctagccatgaaagcagccgggaggggggttgtaccctgcaaagccacaggggtggagctgcccaagatcatgggagcccacctctagcatcatcatgccctagatgtgagacatgaagtcaaaggggattatttttgaactttaaggtttaatgactgccctattggattctagacttgcatggggcctgtagctcctttgttttggccagttactcccatttggaacagatgtatttatccaatgcctgtacccccattgtgtctgggaagtatctaactggctttggattttacaggcttgtaggcctcgtctcagatgagactatggacttggagttttcagttaatgctggactgagttatgacttttggggactgttgggagggcagaattgtcttttgaaatgtgagtacacgggattttggagagtaggggcagagtgatatgatttggctgtgtcctcatccaaatttcatcttgaattatagttcctgtaatccctacatgtggtgggagggacgtggggggagacgactggatcatgggggtggttaccctcatgctgttttcatgattgtgaattctcatgggatctgatggttttataaagggcgtttcccccttttgctcagcacttctcctggatgctgccatgtgaaaaaggatgtgtttgcttcctcttccaccatgatcatagtttcctgaggcttcccaagccgtgcagaattgtgagtcaattaaacctctttcctttataaattacccagtcttaggtatgtctctattagcaggatgagaacagacaaatgcacagaccaacaaggagtatgtggtgagctttttcctgccttgcttttttgaaagaggaaaacaataagatcagaacagattatcactaaaattggcagggggaaagtgtggcacagtcattagaaaaaactggactttggagaccattttaggaaatcttggaatactagcattgtttggggccacttccttgggtcatgtttaagtaagatttgcagcagcccatagatgactcactgaaatttaatcattaatggaatattttataaaggggcagtttataaatgcatagttgaagtacagggaaaccacaagggatggcaccacccccaggggctagtgatggcagggacagttatctgccctggtctgaagggttaagaggagaggagggagccctctctgaagtggagacagtgaggtgtgtgtgcagaaggccacctgacgtgtctgagaccttcctttgagagatacagccagccctcagtgacccagcagggaagaagcaaggataaacacctgattccttttctccctgccttccctctgtaatgagttttgtctgttggtcaaaactagagactcacagagtgctttggctgggtccgtaaagaccaatctccagggaccaaagaaaggtggtgaagggaggagctgggtaaacagaagctatccagcctggttttcatctatccagagctgtacacaagatggtggattgaagatgattaaacacaacacagtattataagttttagaggaccaaataatgtactttaaaactaatgcaaatgtgatttttttgaaggctcatttcatggtaacactgtgcggagctcttaagtcaaacatctctttcaatcctcccaacaatctaggaagataagttatggtctccgtgttctctagtagaagaaacagactttaaagattttggtgacattttcaagcaaactaccatatacagagtcagagccctcaaactgtgaactgtatccttttggggttgcctttgtccccaagaacctccttgtcttctctggtcctcatttttcaacacagtcaagaaaatatctgtttgtttcatgactgagcattcatgagagccaaaaggaaacaatgatttattaaagtgtctatgtcaggaagttcttattggctgctcccgttgttaattgagtgtcttgaaacccttctggtgctttgtaattagtgctccaggacaaaacatgctgctgcttttttctcatcccctaaattttgccatttcagcacaaagggagctcaggtgcatcaggagccccagcctcctgcgactggactgcatacatacaaatacccattctaggtggtttccaaaaggactccatttctatgggaatattttccattgagctgtttatgaactttcacttagtgattaaaaaattattcaaaaggagggcaatagtaataaacttccactttccgtttcaccagcatatctcaaaactaaattaattatcagcctgtgtgaataaagtttgtgtcctgataaatgtattccctcaagaatgctcaattcacctttccccaggtctccagctcacacactgcagtccaatttcaaattcttccgtctcaccatgaatctccagtcttgaagccctctccttgaccccctccttggagggtgatgtggtaaatcaagtcagctctctgtgaatgtctcatcattctccacctgccacagcaattttgccccctctgctctcctcctggggtaaagagtctttccttgttagggcttaaccctttaaactagtcttcccctgctggtccaggcaaggagcctgttccagcatttggttctttcttctccatcttcttcaggtgttctccttccttctttaggtcagaaaagaaattcatgaaaaacaccataaaataaaattttaaaaaatccattttctacctttcttgcaagtgcttttatgtttctatgcatctcctcacatgggatgctcacattcagcctttgctgcaacattgtgccttcctttttgaatgttctacccaattttctcccgtaagcccttcaacagctaccagtggcttcctaatgaccattcacagtgtatgcttctcaatctctgcagcttcgaacactgttgactttcttcctttcctaccccagccttgaaataggtatccatggcaaaacattcagtccctactcttaaccttgctgtctgaatgctgttgcttgccattggactattctggaacaggaagtatagcattctaacagcatggtatatgaagccatatttccctgaatcaacttctagttttagcacttattagctaataagtgtatgatcttaggcaatttattaggaaaaaaattaatctcagtttacccaactataaaatggagataataatgctttgtaggaaggtatatgaattaattcatataaaccaatttcacaagctctgtaaaataagaatttcttcttattttataaataatacttatcttataaataataagatgttatttatgccaataatatctacaagttgacattttccaatattctgcttttagaactgtattaggttcctattgttgtattaaaaaattaccccaaacttagtgacttaaaataccacaaatttattatcatacatttctggagctccgaagtcctaaaaaatctaaagtgtcggcagagccatagcggagaatctgcttttttgcctttttcctgtatcccttggcttagggactattcctccatgttcaaagctgcatttgcatggcttcaactatcagttctatgtggaagattttttctgattttcaggccagtctcatatccccagagaaatgcattcttatccccccaactatttgccattgaaagtaatggcaaaaaccaccattagttttgcaccaacctagtagttgcaggtcgtctccctgtggctgcactccacacaaatacaagtaaacgcatcacaatcctataactaattctgttccttgtcctgatgagcttccttctacaaatggccctaatattccctccatttcccagtatttattgagggatgaagagtctttctgtcaactttcagtgagaagaagtaaataaaacagctttgatggatacccccatgaaccggagtgaaagggatactcctttaaatcatagttatttcgtttgctaagcatggtggccctgagaatatgcctcccagagcctccaccacagggaacacgactgacatgtgaccccagatgctgtactctgaagcccatgacagtatttgggctgacgctatggtttttattatctttcctcaccaaagacttcagcaagggagggatactaaggcaaatctgtttctgggaatcttcaaactcattcaacagctgatcttggctccagggcttccatatggccttgcaggacctttcttagactgcagagaagtccagaacactttttacttagccttcctttcctctctccttcactcaaggtcagattttcatctcagtttgatagctctccccgctcctcccagcttcgtccccattttttctcacccggctgtttcccctaatataataattggtcttcaattttaacttgcatttgctcctcaggagatctgaacttatatgtcatagtctgagtttggagggttgaagggtcaagacctgatggtgaagcccacttcctttgagttccctggattccaggaagacagaatttacaactgccagtaagggagcaaccagacgatgcaaactccttggcaccaagaagagaatgtgggaggaaaatgagatgttttagaaacaacagaggaatctgtgagacagggctgctgtgagatgatgtcacacttgacataaattgacagttaattgcctggagatttgggaacagttcaggggtgtgtgtatgagagagattgtgcataccatgaacaatggacacaaatatatatgcctgcttctgtgttgtgtgtctctctgaattagtgttccctggtccacttcataggatatttcaccagcacctgggactgactgtaagggggaaatggatttgctcatggacctttcagcagagggaaaaatgggtagaagcttctaggaagcgggaataatttcatgtaaagagggcttttcctgaagacacctgacagagtgggtagctggaggcatatctgccatagatacaaggactttctgccgtgggtgggaagctggactgggaagcccacaagaccttccacctcagacagttgtagaaattcaaaagtcccagcagttttctaaacctggcaggtcacttgaatcacatgggaggccattaaacacaccccaaatattctaaatttggatttcaagggaagggcttgaaaggaagagcaaggaacctggataaaactctaaaaccttctttcccttgcaattgaattagccagcctaatttgaaaaccacactgctttgttgaacagaattcccggaaccaccccagacttgaagtatcattcagctatgtcttcacatgggaaatgtgttgtgctatcagaagttgaattgcttgtttcaatgtgtttaagacaatgtacctccgaatctggcaggaatgagtttaaattctgactctgctacttatcatctgagtgatcttgaataagatattcaacttctcagaacctcagatttcttcgctgtaaaataaggatggtaatgacacctttttcctaaatttactgaaattatcaagtgggataatgataacagttaacattcattttcaacttgctctgtgccagtcactatttcaactcatgtattagctcatttgtttgtagcaactgtctgaagaaggttcagctatgattcccgctttacagatggaaagattgaggcatcaagaggtcacataacttgctaaggtttgcacaactaaacgggatacagctgatatttaaacctaggcaattcagtcaaaatctacttttcaggatagtatgctttatacacacatactatgctatgtgtgtataaagcacttaacccagagcttggaacacactatgtgctccataactattagctaatgttataatcactgcttttaccctgggacttacagtgaattgtcacaactctccagcatctgcaatattcctacttagctgcttgcaaagccagaacacctgtgtcttcatgccctctcctttttgtgcccagcccctgtctcagtgatgagcaggacagcatgcatggatcattaacttactgagactgagaatgtcaaattcaagacctgttgaataaggtcagtaagtaatagtagttgctgtatttctcataagtgttgaaaaggaatccttacagaaatacattactttaatcctaatgtattttgacttcttcaggatgcacaggtgtccagggaactgtagtgtcagtatctctgagaccttaggagaacttcttttgaatctaaaggagggggagttgaaaggcatctctattatagcaaaaagaaattagagggctgattcatcctattctgtagggaaagcagaactctgctcagagatcttgaagtaagtaaaacatggtagttacttttggaggaaaataaagtaccatcgaatgtagaatctgatggtttcagtgaaggtaataaatggtgctttgatgacaactgtattcattagacatatttgtggctttcctcctcctttctcttgcagataaattctcactcaggccctacagagataggtgcgtggttttagagatcatcagatgtgggtttaagatcacttttgccacttcccatatgcgagatcttgggcaggaccctcaccctctctgaaccttggcctcttctttctgaaatgttggtaattgatatggtttggatatttgtccccatccaaatttcatgttgaattgcaatccccagcattggaggtgggacctggtgggaggtgactggagcatggggacagatttctcctaaatggtttactaccatcttggtactgttctcatgatagtgagtgagttcttatgagatctggtcgtttaaaagcacatagcacctccctctttgctctgtcttgcacctgctctggccatgtgttgtgcctgcctccctttcaccttccaccatgactggaagcttcccgaagcctccccacaagcagagcagacattggcatcatgcttcctgtaaagcctacagaaccatgagccaattacacctttcttctttttaaactaccctgtctcacgtacttctatatagtgacgtaagaatggactaatacagtaatactcttacacttattgtagagatgttgtgggacaacataagacaattgtaaacacagtctgtgcctgcaagttcagccaggcactctgtagagatcaatactgtccctaggatgctgtgaattttcatattggtacgtctgagcctgagtaacacttggcaaccagagtgagccccagaactggctcatgtggaggtcagtgacaaacctttgacatttgatacaatcaaaaccaagccgctttgtttaaaatgctcatcaaatacctaccatgcacactgtgtatataaaagtcattgtcacaaaagccctttttcagaatctctagcttgccatttctctcagatttcttattgtcctctgggtcaaaaacactgcaaaatttcattcctttaccacagcaagcttttatttctggtgtacacacccgagtgttatctggaatgtggctgctctaagctgggcctctgctggatttaactctagactattggttgagctaaggtcttcttcctgtgtctcttatttttctagggatagcagaaatgaaagaggcaagtccaaccacacaaacatatctcaagcctttgcttgaactacatccaatagtacctgctggtcaaaccaagtcacaaggataacccaactgtaagaccatggcaaggtgatgaatgtctacaaataccgcaaatgggtgaagaattgagaccatatctcattctgtcatacctggaactccaaatttcccagttcttttaaacttttatgagttaggtactttcaagttgtgtaggacagactcacctggtttgggtgagttaagtctatggaaagggaacagaaaacatgtgaggaaacacttatcccatctattccatcttatcttgatggaattagaatttagggattcacttttcagggacaaaaagcattcaggaaggtgcctcacacaaaatggctactcaggaaatgtttatggagaggacatgtgaatcagtgaggagcggctgtagcactggtcaccttgccgttttcccagaagtagcctccattgctccctcctctgtggtcttcaatattctcatgattcaacttccctgtcttctttggttcttccagttactgctgtatcccttaaactcgcccaaaaggaaggattgtgttgcattaattagctgtctttctatctactgggcagagatcttatgatatgctgcctcattggcatgaatcagccaatttttgttttgttttgttttgtttgtttgtttgtttgtttttgagactttgagatggagtcttgatctgtctcccaggctggaatacagtgtcacgatcctggctcattgcaacctcctccttctaggttcaagcaattctcctgcctcagcctcctctgtagctggtattacaggcccctaaaaccacgctcagctaatttttggattcttagtagagactgagtttcactatgttgaccaggctggtctcaaactcctgacctcaggtgatctgcccgctttggcctcccaaagtggtaggattacaggcatgagccactgtgccaggccatgaatcagccagttttaaaaggcttctttttaagttgctggtcactggttgaatcgcaaagagtgtaaggaccatgcaaggaattccctatggctgcattcttcagcaagggtctgtgggttttgctattgcttagagactcaaggattttgtgttgggttgccccatctcttgctttgtgattctgcctcttgggatttggaaaggtaacctggatctagcacagagaggtctttctccctttgaagtgttcatcatgatctgatgagtcaacagtgcctcgtctcattgtttgctacactagctggctggaacactaccctcccagcagagcactccctgccagagcatgatactgccactgccaattgaagcacggctatgtttttacatcttgtagcaataaccctccttcctcaatcattgaagactgatcagctgggccaaaaccaaagcaatataacccagggtcgtgtgtgtacatgcatatgtggtgtgtgtatgtgcacatatgcatgtagtgtatatgtatgcacatgtatgtaagagcacgcacacacgtgttctttttaatataaagaaatgcctttagagaatgaaatgcactgggggcatccaaggtgaggagacttgagggaatgttttttgttttttttcttggcaaatcagtgaaagatgggcagataagtatggtgaacccctagtgtgaagtagagaaattggaggctggagttatagaggcagatgttgaagaacgtggaagcttctagaagagctgaaaacgtccatagactgagtaatcggccaggcacagtggctcacacatgtaatcccagcagtttgggaggctgaggcgggcagatcacctgaggtcaggagttcgagacctgcctggccaacatggtgaaaccccgtctctacaaaaatacaaaaattagctgggcatgttggtgggtgcctgtaatcccagctactctggaggcccgagacaggagaattgcttgaacccggctggcggaggttgcagtgagccaagatcgcaccactgcactccagcctgggagacagagtgaaactccaactcaaaaaaaaaaaaaaaaatgcgagtaatgaagggcagattcaggaccgggactggatgctcactcagtaggttgctgtgtcccgcaaggtaggaggtgttctgtgggtgaaaggcaaagacagagaggacatcaggtcagaacattccaagtgagactctacgttccttgaagactccattgtctcatttctttttatatctccagtgccaaagacctaagtgagccctctggatattagataaataaattaacttattaaaggatgaaagagtgaactactaagttaatttgaaattgaaatatagggtaaggcctgcacttacacagagaaaatgaactttcaaaaatgtacaaagcagacaaaggggagacggagagagagaatgaagactgaatgggtatccaactgatacctggaacatggcagtgtgagtagctgaaaaaggaaaagacctcaaggaatggggctgtctgtggggcctatatttatgttgacatcactcacaagtacaagtctgcatccctgggtgtcctcagacaagcatatagtttgcatatcgtattaccttttgtgttagtaatcactgattttgaatcttagctgactgtggaggtgctgttctgcctttgacatggcagtgtgagctggagagggatggggagatgaagaagccacatgtcccaggaatatcaggatcctataaacttattctgggtaaggcagtggcaagggtgaccagcaaagtggtgcctgaaggctgggaatccagtcatgtcaattttcttgtttgtttctctctggcaccttctctaggcccagagcctagatgaggctgtgtggaccagtgatacaatggagactttaattttctcgattagtgcagaggatgaagaaatctcagcagtcatgctgtattcaaggtgcagggtattgcctgcttctgttctcaatgctggctctcgtagcttaacccacctatacagaagtgacttgttttcatccccgtcctggccagtgactctttaaccaggcaatgtgatttacgtttagatgttagtttaatccctttgtttcttaatgaagctgcccttgttaaaatccctgggacctaatcatagaaattctctctagccccacgtctccgttcaacaactgcttagcaaatttctcatcagtcccatttttttttttaccagctcccctcaatagccatttcttgtctccaaggttttttgaagcccagaggcttttcttgtcaggcaattctcttatttcagccctgcagtgaactatccatatactgtatcacatcatgattttttttttctctgcaacctctcccttccccttgaaacaacttacctttatctgtgttccaaccccaatctgttgcgtctagaagtcagagagccaactgccaatcattctagaattcagcattttcaaagttcatctttgaaatggatagcctcttgttctgcagaaaagcaaggatcctagaaaaaacatgcaaactgcatttcaaggaggatggcatcatctttttgtttctcttggaatgactcaggagtgaggaaacaggaatacattactgtggttcccactcatcttggcctaccaatctctcccatctttctaggtacagcccatcttgtgatgggctgggacctgggcccctcctggacttacgttcaggatttcaaataacttggatggcagtctagccaaggaagccaaaagcttccatctcttccttgtcgtttgtgtgggttttttggtttgggttttttttttttttttagagacagagtctcactttatcatccaggctggagtgcagtggcacaatcacggctcactgccgccttgaactcctgggctcaagtgattctcccacctcagcctcctgagtagctagaattacaggtgcatgccaccaggaccagctatttatttatttattgtagaggtggggtcttgctatgttgcctaggctgattttgaactcctggtctgaagtgatccatcttggcctccaaagtactgggattacaggtgtgagccactgtgccccacagtatatctttttaaaatgaagactttcttatcagatttcagcaccaaggctcatacatatgttgactcaagaattaaagggctttagtttcatgtgctggcactaatcaatggctctggtttgagaacaattttgaaaccatactcgtctcattggaaaagagggcagtagtggtgcctaccagagatagggcatgaggaagcagtagtagcatccctgccatgcacctgccatccttgatttgataaagtccagaagcacatctgatcacaccatcttgcacaatggccttctcccaagcaacagtgacaacttagatggcctggaaaactatttcaaactaatagcaacatgtctaccaagagtgcattattaatgacacattcaactgaaaaattgatcacacgctcttaggtattacatgggtcacatttgcaataattttggtttttactgctgaaaggcaaatttaaggtaaaaatcaaatactttaaaagtatatatcttaatatgccttcctcttaacattcatctagtaaggggggagatgtagaattttgatataaattggccagccttatgttgatttatctttaacacagatttcaactccttcacttcagttgccatgaactgcaaggcccttgttcagtctggcttttcatctctttcctgcccaagtccaatttagctcttataaaacaaccagactactgcaatccctcatctcacggcaacctccaggacataatatataaaacttacccttgacatgtgggtgggtcaaataagtgatcaaagggcaagtcatgatctgaaagcatggtaatctcaagcaaccgctgatgtgaacattgcgtgtggcacagtgaaactcaaaggactcctgattttggcaataaaaacgattgtgtctataaactgagagaattatagaagtttgagcacagctgatcttagccttgaacatagttgaggaagagggaaggagaaatttaaaactttaattctgccaatttaacaaaaccgcttcacatcattatctaggatgagagtgatataaagaaatttaccagaactttttccattaatcaaaaagaaggtagtgaatgagatggaggatcaatcatgtcaaaaatttcagaaagggatgaggaaataatttctagcaaattatataataaaagtatgtttccactgaaaggagcattgaggaagaagaagagtatttcgtagaagtgaaacggcactgattaacctcattaaggacatgacttcctcatactttaataggaagtggtaaacttcagaatgagaccagcactatgttgaagtatgtcctagtccagcctctgttgtgagctagctgggaaagcatggccttatctgtttcagtatccttatttgtgaaatgaagagcttggcctgaaatcagcagctctcaaattttcgtgggcatcagaatcaccaaggatgtttgtaaatgtttttaaaagtcaattttcaagactccattaaatggagattttgatatatacaatcagagttaaatatgtgtatatataaaaaatatctttaagctagagtctcttatcagtgagactttgggctctacgtgcagagagactggtttacaaccagtcaaggggcagggtggggatagaattcagaactttagagataatctaacattctcagagactagaattctgcagtgttctggaacaataccccaaggtcaaaaagctttaactaaatgtttgtatgatcaataaattggtctgatttaaaattagcctataaagacattttttaaaagcaaatgcttaacttcaatactacatgacaagagggtgatatacaaaaaaaagttactatgtggttcttggcatcaagcagattaaagtctactttgaaataaagaccataataagtagttgaccccataaaaattaagcaataatgggaagaagttcagaggaacagaaaatcaattcatgctgagatgataatcaaattattggtaaaaatgaagatgctggttaggcatgtccttggctagagaagggctcaggcttgcaggtttaatgacctttagctgagaccaccccacgtgtccatctgcctcaggatactctaagtctcgtggctgaagcaaagtcttccttaaacagggcttccattgggccatgccagctattttgtttgtttgtttcctcaagacttaccaggccctatcttctgattccacctttgatcttaggtaggttaattcagttaatatattactaataactgtctacactctttctgccctcgatatctgtttccttctgctaacattttatgactattctttgtgggttaatttcacattttatctcccaaaggcagcccaagttccctcctttccagatgtcttgggctctcccaccgtagagcattggtgctgcctatactgttgttcttgatttcagagaacgttctacatcatacagatgcttacgcttattaaactactgatttaagttgttgcaggttttgagttaccactggcttttgactcagttgaaaaaaaacaaagaatggtccagggtgagagaggtgtgtaaattgactccgtgaggactctaggaactgatctttgacttcctcgccagcctctttgccaagcccaaattcatcatcattgtgaagtagcattgggccatgtttaagaagttttctataagaatttattttggattaatagcaaataattgcagctgagtcagcattaaagacatgttatatcagactgtgtctgctagttcagaggatgctgcttctcggatgggacttagctgaacacgtgttacacctctggggaagtgtctacagcattgtaccaaaaaacacagaaaacaggccactgaaacaaacaccagcagacatagcattggcaggatctaacaagcaggttttcctgaaacgtcattttgacagggttatagtcaggtggaatctcttaactgcagtggtcacctggtgcttcgttctttggtgcacagagagggggctgcagaggattaacatggaagaagcaagcactccccctccgttgttacccctccctgcaagatcctgaagccctgattctttccccatcattatatcccttttcaggaacggaaatgtcttctgcagagccagcccattccctctggtgctggtctcaggggaagtacagcatctggctcccaccctccatctaattacccatctgtttgtggggagggaagggatgttctattccccttctcttcccaaacattttaatgtgctgatgcatgaagacgacagcagctgcacctcagaacccatcctttgtgcatcacactcactggcttagcttttctgttcagttcttggatgggcctctttatagctagagacccacgtctctaactcctcctcatcctgacttagtacaaccctggcccttgcattagactgctccagattccatgttgctctctgattcagcatcatcaagcctcagcggggtgcctgagaccccctacctttagggaggggcagggatttccctgctctgctcttggcctagggcttctatcagctccagcaaagagaccatggagagcgtagcctttcatcgtaatctcccaacctttactcagctaatggcccctttggttatttctctctcactctggaagccatgtttagaaagagctgatatactgaacaaattgcacttaataaatattcacttattttccctctttttaaaaattaatcaagttctttgtaaggaagaaaaacgtattagtctttgacaaatgaaactaccaatctccattgatacctacgttgatagtattcaagccccaaacaaacacttcttagctggctcagatgatctggttaaggggaactttgtcagtttagttcagctttgtgaaatactgaaggatttcagaccactattaatacctgagtaaagtggttaagagaataactttggacatagagacagatgggtttcatttggccacatactagctacatgacctcgggcaagtttctgaacttgatgcggctccatttcttcatgggtaaaattggggtaattatactattgatcctgtaggattatcctgaagatagaatgcataatgtttacaaagcacttggtacaaagaggcataaagcaagaagtgagtaaatgttaactgctgctatctttattcccgtcattttaatcatcactatcaattatcatcacaacccaagtggctcagggatggagagaccccaactaggaccctctctccattctaggggaaacatttattcaactcaactgtggccagaactcatagtgaatctcgctatagtcatcctccgttttgcaacagcagattttgctgggctcgtggtcactcagctaaagactactttctccagccaccttgcatctaggtatgaccatggaactgggtgatggccactaagacatgagtgagcgtgatgttagcacattaatccatgcctttgaaaggcaagaagtctattttcccttcctgtttttcccttcttcagctgaaacgcaaacgtggtggtgaatcatcttgaattaagctgaaaagggtaacatggaagagatggcatggcaacaggatgcatccccaataccatcaagccaccattccaattctggactgccaacctagactcttaaataagggagaaaaaaagtcctttttgctttaaactactgaatctgatatcacctattataacaccatggtgtatcgtaaaaacacaccaaacaactattttcaaaatagatgtgatacttctccccagttatacaacttctggaagcaggaagccactgcattcccccacccagcttgtcatggtttacttctgattggatataactagatgataacagggatcacgctgcatccattgaggagaaagatgattcaaccctctcgcgggctgctggggaatcgatatcgtttaattatgagaaagtaaactgtgtttacattttacacagtggcaagaggaaggtcaaatcacaatcctcataccctttatcaaaaccatgcatcgctgtttgtcaagtgagattcaaaatgggatgaacttggagagttgccatcttcctgttttctcccttgtttgttcatatggctgtgctttacaagattaaaaggcttaccgggcaaaagcatagcagaaggaagtaaaaccttcgggcagatgaaataattcttccattttaggaaaaaaaggcaattagttatttgaggttttctgggtggggcagtgagtagaaggtcattatgttcctttcctgttgtatatcgaaaatcagttgagaagtaatgaaaatggtaagaaaaagaaaaaaaaagagtaaaccctcttcctctcccagtggcctctaccccatgactcatcagcttcctgaactggaacaacactgagctttatgactacagaaatgtcagctctgagcacagtgcatacttctttgtgtgaagatcttaggcggttgtgcaaaagccagcccaggacccagcatggtcctgctttatctctctgccgggctagtctccatgttcattagaaatgtgtgatttcttgacaagcactctttggatttgctgcagagtcaggtgatacattgaaatcagcaaaaacattaatgatagcaacaacaaaaacgaccttgtttaagttttacgccttataagggggcaatgttagccttgtaataaaaatgaggtaactgcaacttggaaatattaggaaatttatttaggatatcttagaaaatcataatgagagtgatgatgatgatgatggtagtgatgatgattatggtaatgataactatagtgatggtgatgacgatggtgatggtgggggtaatggtgatggtgatggtggtgatgatgatagtgatggtgatggtggtgatagtaatgattacggtggtggtgatgatgattctagtgatggtgatgctgatggcggtgatggtgatgttgattattatggtaatgataattacgatggtgttgttgatgatggtggtggtggtggtaatgatgatggtgatggtggtgatgatgatgatagtgatggtgatggtgatgatggtgatggtggtgatgatgatgatgatgatagtgatggtgatggtggtgatggtaatgacggtggtgatgatggtgatggtagtggtggtgatgctgatggtggtgatggtggtgatgatggtgatgatggtgatgatagtgatggtgatgatggtggtgatgttgatggtagtgatgatgataatgatggtaatgggtggtaaagatgataatgccttactctaggctagatattgtgctaaatatttcactgacaagcaaatgtgtaaactcacagtgctcagtattgtgattgaccctaatacgttttcactaattgttggcttcagggctaggactagagtgaggtgaatgaggtactctctttgggtccaaatttaaagggatacgaaaaatctcagtaattaaagtaaataatatttaatgcaatattttataaaaataaaaattagtgcaaaaatccatggtaaacaaaatgtcaacattttaaataaaggttctgtacatgcacaatatattctatttaccttcccctaatcccacccagttgtctcagctaatggcaatcttattttatacttgatgaaacaagcctgagcccaggttgttcttatccctgttctataggtgaaaatactgggcacaagagatttttccacaatcacatagctaatatatggaaaagctgggatttgagctcagctatatctaacatagaagttcagcagtctatctggcttctaaggtaagtttctgtcacaacattaaatattcagtatcattttctgggctatttttaaatggtagggagtcaaagagattaactaccagttgcagctcttatcaggccaacaatatcagctaaggtgaatctgatactagtagaactctaagaatgtgcatttattaagtcactcatataaataatatatttaacctacttagaaactctgtatagaagatatcagtgttgtatttcataaatagagaaagagaatctcagagttgagcactcacagtcatggtcaattcatggcagagttggtgaccagctcaaattttctaggttgacataatcctgtcctttctatggcttcaaagccatccacgtttgtctcttgatcctggaactttttatatttcgtcatacagaccttcctaagatcctcactttgcttgtatcattttccctagaataactattttctaaaacgcattaatgcattgattttaataacatcttgtgtcttatgtaattttaaaaatcagcatatattgactgaagacattttgacaaaagagaaagaaagaacatagcaaaaaagcatttccaactttcataaataagcaagagtatcactttcgtgaagttcttttctattttgttttgtcctgtttttttatagtgacatgtaactttttctttttctggacagcctgtcctcttggtgataataaagcatgatgataaaacaaatgagatctcactactagacttttctgtccaggaaatactcttgacttcatctgtcctcacctctgcttggaccttgtttcatccaatacctcatgccactctcagctttccaatttagatccttctcttgggtcattctcctctgctatgaattagcagacattgatcttgtcctctgacaagtagttatcagcagttattcataaatggatttagtatgttccatatccttagaataacatatacatataagcaaaaattaaatataatcttaggggtttcacaggctcccctaaatctcattcatgtacgccttaagcctgacttaagaaacgctgccatgtaatttccccttgatcctttttttttttttttttgcagatactgccccttctcatttttaactttcaccaacacttttcttgttaaagaagctttcattctctgccgctgtaattttccttacgcacatgaatatttatcttaatcaagtttctcctcccaagaacatcccttcagacaccaaaacgcgtattcttccacgttccatcagcagaaactttccttcatttgatacttgaagtccatcgctctggtgaaagcatccctcttcttgtttttcattatgttacattctttggacttgtcctcttatctatgtaccttgtaacttccatttagccctcttttctctttcaacttccttattgtagatactccttaatgttactagcatttaagttgtttttttcccccctcctttgtcagtcccaaagctcctatggctcaactgttggtgcacataaccttagggaggtgatttgaagaaattttaccgaaatgttgtatgacaaactcccaataacaggatttaagagaataccacttgttcttaccccttcagttctcttaacagggaagaaatatcataaccacataacacatgtttatatatatagatatgcccttacatcaaaataaattcttgatgataccaagatacgtgttcaaggcaaccataaaacactggaaaaaaatcaatcagaggtgaattttttcttatcttatggtcaggcagagtttaagcatgacaccaaaagttaaaataagctgaaaattgatatcattggctacataaaattttaatgcttctgtacaataaaaactgtataagtattaaacaaatgacatgtttaaaaacacagtttgcactatatattccgaagggcaaggacccctctccagcagctgtcgtccagcacatatttaacgtttccatatatctctgtcctcatcaataagatgaggctaatgacgctgcctctgcggtccttctaagaagcagatgggataaaagagtgtgcaccagtagctctaaacccgggacaatttcaccccctgagggcatttggcagtgtctaatgacatttttggtggtcatgctgggggatgctgctggcatcttgtgggtagaattcagagatgctgttaaacatcttgcaatgcttaagacatccatgcagaacaacaacaacaaaaaaatatcctgcccaaaatgtcaatagtgctgtggctgaaaaaccctggtctatacagggtggaggatgttgcggagcgtttggtacctggtaagtgctcagtaaatgtcagtcatttttacatcttattgggcaattctatgtaaatgccttgtccctaggaatatccacaggtttagcttatttttttttttttttttttttttttttttttttttttttttgagacagagtttttcctcttgttgcccagactgtagtgcaaagctgcgatctcggctcgctgcaacctccacctcccaggttcaagcaattgtcttgcctcagcctcgcgagtagctgggattacaggcgcccgccaccacgcccagctaattttttgtatttgtcgtagagacacggtttcaccatgttggccaggttggtctcactactgacctcaggtgatccactcaccttgggctcccaaagtgctaggattacaggtgtgagccacctcacccgaccccaaggttgtctcttttttcttttctcttttttttttttttttgttttgttttgttttttgagagggagtctcgttctgttgcccaggctagagtgcagtggcgcaactgcaagctccgcctcctgggttcacgccattctcctgcctcagcttcccaggtagctgggattacaggtacccgccaccatgcccggctaattttttgtatttttagtagagacagggtttcaccgtgttagccaagatgatctcaatctcctgcccgcatgatccgcccgcctcggcctcccaaggttctgggattaccggcgtgagccaccgcgcctggccatttatctgttaaggacagaacatgacttgagggacagcttactcattctatgcctatttgcttttctctctttcctcagcgcttttcactctcagctaccccttccaaacctcagctgattttactaccattcagatgtatcacttgtctcctgaaaaacacatagagcttcctttgtgaattcttactgctctacttacctgcttttaatctgtttatgtgagaatgttgtcaagatcttctagtagatcgtaagtcccttgaagaaaaagatgactttatatttattccaaaaaacccctgtggtgaccacacagcatagaaatctgcacagagcaggcaagtaacttacgtttgcttcgcaattccatcttcttaagtcgttcttgcaattgagaatgcatttctagccttctattggagctgcttagcacaagtagtgttgcattggtgtgaattcctccaacccatttaaatgagtttattgtgcattcaagtgagggttattcagcatgttcaagcaaatagtgaccaataatgataatggatattttttcatctcttcctgctccaatgggccagtattcaaaatgccattgctcacatgaaaacagagctgccagaccgtgtccagggcctcagccagggagctgccactttcattttaatttaagaaaaagagaaattgactgggaggtatttatgtaaatcagtagagttctaaggagttatctggcagccatgttaatggatgtgccactctgagaagcgaatctcgcattttgcttctcttgtcagaaggggttctgtgtgaccatttacacctacggatgattggctgtgacccagaggacatttgatgtaaaggatattttgtgcatgtcaatgagtcctgtccaggtggtgggatacaggctcgagacacatgttggagaagatcacttttgactgctggggagctatgggaagcccttccaaatgggcagaatgtgcaattactatctcagtaaatttgtctcaggagagctgtacacctcaggaacatcatatcatagaaaagggaagacaaaaaaggagctcaccttaaaagttccaaccacattccagggactgtttgtatttgactcattcatttattcaacaaatgtgaactgagcacttcaacgtgccatactgtcttctaggcactgaagatacaacagtggatatgatgggttgaatgtcggccccaaaaagatatgtccacatcctaatccctagaacctgtgattgtgaccttctttggaaaaagggtctttgaagatgtagttaagaatctgataatgagaggagcctggattatctgggtgagccctaaatccattgacatgtgtgcttttaagagacacacagaggaacaacactgcaggaggaggagaaggccatatgaatacggaggcaactcttggagtgatgtggcctcaagccaagaaacacctggagccacaggaagctgaaaaaggcaaggggtggaatctcctctagaacctatggaggaagtgtggtcccatcaacatcttgattttgcagcttccagaactgctagagaaaaatttctgttgttttaagccacaaagcttatagtttgttatagcagccacaggaaattaatacaataggctaaacagacaaaaatccctgccattgtgatgtgttcattctcgcttggtgcagacaggcaataaacaaataaaatgtattcaatgttgggttgtgatcaatgtaacacagtaacgaagcagaataagcggggaagaggtttgcttgtgagtggcatgatcatcaggaaagatgctactgagaaggggcgttcagagactgggaggaggtgagggaatgtgccgtgtaggtatgtggaggaaaagctgtctagacagaagggaatgaaactgcaaaggccgtgacactggagtgtgcctagtgtattggaggagatataaggcagcaaaggctgacaagaccagattatttagggcttttacttcaatttacccattgacttaacacttatctattgagcatgtaccaaatatattgttttacgacattcttgcaaaagcctggagaggtaggtaacaaaattcccactttaaagaggaaaacactgaatactggtccagcatgactcagctcatatgtggtggtactagaataggaatcttaatttgatgccaaccccagtgtcctttccccaacactggaatgacttatgtaaatatttatctcatttgtaatttgtctgtgtgttcagtcccatatgacagtcttgataagcccagctggcctctgaggccaatgcaaatatattttgagctgagaattgctcttgggcggtgagaggactgtagtttggaaaaggtcaagggctgtggattgccatctctcatggtgtcttcagaatgtttcagtagctttgtgactccaggtagcattgcattgataatttatctatttaactggcttaagtgggtttttttttttaattttctatctcaaaaatccaggctcataaatagggacagtatggaaaatgctgtatagggagaataaataaatgtataatcaggttagtaacatattatcattgatgcagctactgagcaaggaaaagcaaacaaagaaggagctttatttcatacccaagcaagtatagctcaattgcaaacctctcagacttgaatatatcacattggtcagtgcatatcatgtcctggaatgttacagaaagcagtaatggagagacaggtggatgaactaaaacttaacttacctctctcttcacatagcattagagcacagagaagattactacgacccttgggcatctgtgactactccattcaaaggttccttagaatgtttgctggaagcagttacagaaatgtgaacagggcttaaccagtgtactccataccctaaataattctgtataaataagagcttacatatctatgatgcctctctgtcacttcttttatattctcctttagtttgttttggggaaaattctaagtggatttgctccatgtaaatactgtacttccttatcgtattaacaaaggaagaggtaggagaatcaagacaatcgaatgtgtcagactaaagtagataataaatgctctttgggaaaaaaatattctcagtcaatgacagggaattctgatttgataaggaaattttcttgggttaatgaatgcaactgtagaatactgagtccgaccagcagaaacctacagccccaggccagctgaatcccattccttataccgtgagtatctgtgttcccttgcagcgggttttgtaggagtcagggataaagatagggaagcaggaggaaagggtcatagaatgctgccaaaggctctggaggctcaaaaggaagaactttgaattcacaaaacactatgccagctcagacctgggcatccaaatcagttaggatattggctaacagctgtaataaagaatgctacaaaaacagaagcttaaaccaaatagaattatacttcttcctcataaaccactccagggcagcaaggtaactcttcttttgaatgtcatgcaaggacccctgttttgttttgttttgttttgtttttttcccaagactgagtctcattctgtcacccaggctggagtgtattggtgtgctcactgcaacgtgtgcctcccaggttcaagcgattctcgtgcctcagcttcccaagcagctaggactacaggtgcccgccaccacacccagcaaattttttgtctctttagtagagtttgtctgtgttagtcaggctggcctcaaactcctgacctcaagtgatccgcccacctcagcctcccaaagggctgggattacaggagtgagctactgtgccacccagccaaggactcatgttttgaaaaggctgtggattatcatctcacattatgtctccagcaagttacagcagctttgtgattccaagtagcatggatggagatggcacttgtcatccccagggtggtatcctcattcctacctcctgcaccatagccaggctgtaggaaacagactgggaggaacaggagaagagcatcttccttttaaaggacattgactagaagtttctcctaatgctccctttcattccctgttgagcagagctgagtcacatggctatggcccgctgcaatggaggctgggaagtgtagtttctaactaagtagccaggtacctgaataaaacccagagggtaggagatgagattctattattacaagaagacacaatttctgccagggctttaaccggtggctctacccttcacagctggacattgctggatttttggatgattatttcattgtctccactcaaagattaagtttggaaaatagggaatttttctaccaaagcataggaactccaggccccagcccctcctcactctttctccctgttcattctcatctctttccagttccttacctcctgtaacctgtgggcatactaaagtaccaaggtaggcttagctgcaggcacggtacttccatgattcagtgccccgcccccaccactgagctaggccactcccaccaacaacctcaggccttcagatgcccaatttctgtgtagagctttgagcagtgttttccagttgtgaagggcaaaggaaattctccaattatttgtgtgttcatcttctctacctcccaggtaaaaaggagttgtctcaccattatagcttgtttcagaaacagtgtcaaattctcatcacagctcatgcatgccttctcaccagaagtaccctaattggttctctgactccaacaagagagctaggctttttgtttcttttgctttgttttgttttgatttgctcctttaaaaatgtttatggtgagctcagttatttaaaacaattcctggcagaggatttaagaggcctggcagaaattatgtaagcttgtacagtcatcttcactgataatgagtaaatcagatagcagacattaaaagattaagcactggtgtttggttttttggttggttggttttgttcacttgtttttaatgttgcaaaagtccttcatatgtcattgacaatagaatttaagtatttttgaaatgtactcagttcagattcaccattacatttcatgtccttaaggttggtagcttaagatagcttgtgcttcagttgcacaatactggcgtcagctctcctttaactcaaagctttctggtaattttcatctactggcagctcagtgggggcattttcaagtctcaatcacatcactttaatacataaacaaaaaagacccaacacaatagcaaatgaccatgagcttagtgccatcttgagtgtatgcttttagaccccagtgatgatacaacctttccttaatacagagaggaaaacaattttgatccgagaggctttctcccaggtgcatctgaaaaaacgttcagatatgtctcctgaatggttttgactaacacaacttactttcccccagaatagctcctctctaaaaaatgccaaagcttgcctttcagggacaaatcaaaggctaagcctgaggatgatggggtgacttgaaaaagactagccaagcgcttgactgctcagtgcagcctcgataacaccattcttggtggtgccatttgctccttgtccacagcccatatcccaatgagggttattcacttttgtaaccactggtttccctctgatagtgtctaaagaagcaaataatgatgaagtgagctgtacctccaacagagtttgaagctagccaggagcccttactgatgtttaaaaactggttcttttcaaaattgtggcaactttattttcagaaacaggtttcatcccaataagttatttggatgttttagaatagaataacgccatttgttgaaattcactgaagtaaggaacaatgtaatttgccactaaaattttgcacatttcatttttcttcaaaacacccagttttgattttttttgtttgtttgtttgtttgtttgtttgttttttttgagacagagtttcactcttattgcccaggctggagtgcaatggcatgatctcggctcatcacaacctctgcctcccgggctcaggcgattttcctgcctcaacttcccaagtagctgggattacaggcatgcaccacgcccagctaattttttgtatttgtggtagagacggggtttctccatgttggtcaggctggtcttgaactctcgacctaaggtgatctgcccacctcggcctcccagagtgctgggattacaggcatgagccaccgcgcccagcatgatgacttaaattctaatcatagtgatgttatgttcattgacacattactctgtgctaggcaccgtgacaggtgatctatgaatgctgtctcatgtagtcttcactataatccatgaattatatatattaacatgaaacccatttcacacgtgaggaaactatggttcaaaatggcagttagcttctccaaggttatataactcttcaggttttatccagaatcaaatctgagctctgattccagagttcttgctctgaactctattgctttcatgataaatttccctaagggctaaaaaatacctcgtaagaaaaatgtcttaaggccgggctcagtggctcatgcctgtaaccccagcactttgggaggctggggcaggtggattgcttgagtccaggagtttgagaccagcctaggcagcatggcaaaaccctgtatctactaaaaatattagctgggcagggtggcttgtgcctgtagtcccagtaacttgggaggctgagatgggaggatcacttgaacccaggaggcgggggtggcagtgagctaagatcacaccactgcactctagtctgggcaacagagcaagacgactctgtcaaaaaaaaaaaaagagagaaaagaaaaatgccttaaaattattatgcatgcaactttttctttctttcttttatccatagctatacttggccaaacaacattaagtcaggttatatttgtccttttcctcaattgttcctacctacctaccgacttacttggctattttcattcatcattaagtgattgatggatcatagttgctaagagaagacacggaaatgaaggaaatcaacccattccttcattgattcattatgtttagagagctaccatgtatgaggtattttccaggactttatgataccttaagcttacattctcgtgaaagaggcagacaataaatagtataaataacaaaaacatactatgggatacgttttaataataagaagtgctaaggagaaaaaaaatagcagagaaatgtcagggtaaacatgtattgaaatgttagatgggctgtccaggaaggggcagataacaaaggtgacctttgagtagatgccagaaggaagttaggaagttatgcaggggagccttggaaatgtgggggaattgcactgtaggcagaaagtacagcagatgcaaaggccctgaggcggagaatgcctgggggattgaggaagaactaggagaccagtggggccgagtgactgagtgagggtgagagtagcacaaaatgcgtacaacaaagtatgttatggagaaggctgtaggttagaacaggaactttaactcctaattaggtggttttcagtagacgagtgacacaaacataatgttatacttggacctttgctgtgttgagaccactgggtgtgggagatgggtggatgagggattgggaaatcagtgaggagcttaccaccgtaacccaggcagaagatcatggtggcctgtgccagaacgaggccttcctctctttctccctccttcctttcatcttcacagattattctatattagtccattctgacactgctaataaagacatgcccaagactgagtaatttatggaagaaagaggtttcattgactcacagttcagcatggctggggaggtctcaggaaaggtagaattatggtggaaggggaagcaaacacgtccatcttcacttggtggcaggaggaagaatgagagctgagtgaagcgggaagccccttataaaaccatcagatctcgtgagaactcactatcatgacaacagcatgggggaaactactgccattattcaattccacccccaccgggtcctttctaccccatgtggggattatggaaagtataattcaagatgaaatatgggtgaagacacagccaaaccagatcatagtccatgtctacttcattcaagagaatgaatgactgaatgacacttaattgggtcttttgatattagcatccagtattttgtcatcttctgagaggggctacttctggagacagtgacacagaaaaccagtgctcttgatttaagcagagtggatcagtaagaggtgtctctttcatttgtttagattatgatatttattcaaagagaggagcagtgaactgtggttgagtttgttattttaatgaaattacacttgcaactattgtaggtgtctttctatgtaatggatgctttacattctctcactttttttcctccagacaattctagacagcaggcatcatgattcccattttatagatcatcaaattgaggatcagagataccctgcaaagtctcatatggctgagtagcagtactctttacatctgaacccaggaccactctgactccaaagccaatattctctctgcatatttaatagctgttctttttaaaaaattgtatctattagtgcatatttgatggtggataatgtatatttaataaacccactgagtcatgtagctgtacaagcatttaggagattatgccatctaggaaattaaatattatcaagtgttgtcacacttgagcatgaacaaatacagactgctgggctctatccccaaagattctgattagaatggctcaggccgggtgcagtggctcacgcctgtaatctcagcactttgggaggccaaggcaggtggatcacctgaggtcgggagttcttgaccagcctggccaacatggtgaaaccctgtctctactaaaaatacaaaaaattagctgggcatggcggcacacgcctgtaatcccagctactcaggaggctgaggcaggagaatcacttcaacccaggaggtggaggttgcagtgagctgagatcacaccattgcactccaggctgggcaacaagagcaaaactctgtctcaaaaaaaaaaaaaaaaaaaaaaaaaaacaagaatggctcaggtaggggccaaaaatctgcatttctaacaagctcctaaggctgctcatgctgctgatcctggcacagcactttgagaatccttggtccacgccaatcccatcatttttgcaagaacaaattggaggtcagagaggttaacactattttcaatgatcagttaatacccctcccacctgcattaactgtaagagaaagcttgaatgacagagatgcacgactgtcagaaatggaaatgtagggtttttttggcccctttgcttgttttaattcaagagtataaaccataggtaatgttgtgctctcactttctcctgatttatctccttttgagcacttaatgaagaggaaccccactcattcacacacacacattttatttctcctgccctttttctttcctttccactttgaaatttctgttgcactttgtagttgtccagaatattttcagaaatacctccttgtgggtgaatctgctgcaaacagggctgatgaagtccctaatggttgttacccagagccctactgaatcaaaagaaatacttattttttctaaaaaaggaatcagtggtgggtttgtgaacctatgattagaaacatcctgcggggacatctacttgttcatatttaatgtcatttactagtagtggagcttacgtgcagttggttgtagcaaacagctctttggttctccccattctttaaggcgaaacttaaatgtaatttcttagcattttgtggctgaagctcaaaccagatggctccttcttttctttccagagcacttagttcacacttctaatgcgtagaacatgcaacatcgtcgcctaattttaaatggcttactcactggccagagtcatgataaataaagatggtgtggaacgtttcttctgtttcatgctcatggaacacagcacaatctttggggctcagtttactgagtatgagacagcaggacaaagtagtaaggggtgtgagcttcgaagccaagcaggttgtttggagactaggtttttctacatctaccacacagcttcactgtaggctcagtttctccctctattaagtggagaaataatagtaatatcacacagagttgtaaaaagctcttaaaatgatgacgtcatgcttgcaaagtcttagcacactgttcagctcatggaaagggctgaataaatattaaatataaaccagacctcatgagcacattcaatccccagggaattagtctgaaagaaggtgagccctcaacttctacaagtagtgcaaatcgaaagcccttcctctcacatatggtaatccccaggggcttgtactgtcatgacccatgttgcttctgggtcctgtgcttgaaaggctgtctctttccccatctgagtcaaccgggcggtaaaacgtggctcctgtaccaggttgcacaagaaacatgcatacacacatatcactgagcaaggtgaatgccactgagggttcggggaccaggggacacctgtgtgatcttctaccacctttccggccctttcctttcttcccttcttcttctactcccagttaagctttcattttccaatgctcttcagcaatcgctattttactctcccaaacttctacagccaaacccagcaagtgttcagttcagcagaacaaagggtcttgctctttgctggatctacctttctttcttagaggggagttggggttgaacaactgtttcgttcattacagctattattaatattttcaaagttattattaatgaaagagtgagtaacgctgccttattctccttttatttctcacccactctttttgtgttcagatcactagattttaattttacgccctttccccagcccaggactaggtctgtgttacccaggaccatttgaaagttgaaagaggaactcattggtgatacactggcttaaaaaactttaggaattcagaaaactatccaagaataacttataaaattacagatgaaatatgtgttatagtttaaacacaatatttttctgagttctttggatttttaagtacttaaaatacacagtgactatctcttttcaattttccaaatatagcatctaaatttagagagatgttaaaacaatttgggggttgtttggtttctttcctttttttttttttttttttggcccctttgctcaaagaaatagtgctttgctttcttctaatgaagtaagccctggtccaaggaaaatataaaataaaatcgctattttcctaccacctttgggctatgtaattcccatttcattttccaagaggctaaattttcaaatggtttcacttacacagtgcagaaaaattagacatcttcgtcatttgggggaaaataatgacagactctctacaagaaaaaactatatatatatgacaaatcatattaaaagataacggatcactttaagtatgggaaacagaccttgaagacaaacagttttgcacccgaacttgatctaagcatgattcccagctaattgtttggttctaaattaaattattccttttgataccgaaattatagatacagttccatttggcacttcagggtatatttattttctctgtaagtgcttgtccatatatttaaagactacagataatggatttttaagtgtatttaaaaagttaagcctcttgagaatttattttaaatggaaaatatctcccagcagattgtaatttaaaaaattaaaggcaatacaatacacatgcatagagataacattcaggtgtttgtgaatcattttccccactctgctgattgtctttgtggttaatcatggaactgatggtgcagaatacactgtggatgagtttacttgcctgagcacttaggtggcttagagcagatctcttgcaaaatgcgagaaaaaatatgaccttggcctacagcagtgatcaacaaacttattttgaaaaggattagaaagtaaatatttaaggcttatgagcgagatattctgttgcaactatccaactctgctgttgcagttcaaaagcagccatatacatgtaggtgaatagtgtggctgtattccaataaaactttatttacaaaaacagtagtgggccggatttgacatgcaggttgtagattccagactcctggtttggaggcctgacttcacaactttgtgtcatcctataggagtatgagttcagctcctggattcagcatctcagttaggcccactctagtgagttagcagagcagccttctttacgcagctgccataaacaaaccaagcaagccatgaagcccacgcttcagtgtcataatcacatttcccttccacatgatctgtacacacctcaaaccccaatcctcacaagtgggattaagagcctcaggaagagctccaaataaatcctcttctcctgtccatctcaccacagaaaagcagatgaacagaaaatcagaaagtcagtaacttgtctattcctcagagttagatgtcagtgtgatacctgacatagagacaatctgacagatcacaaaagtctgattcatttataaaatatctggtgagtggctactgtttgtcaagctctgtgctagtgcgagagatacaagggttgctgggatggcccggtctctgcaagaatggaggttttattctagtgagagagacacaacatagggaggaatccaaaagacagaaggagggtttgccctgagtttcctgttggaaattgggactctggtaagcagctgtgtgataacagaaagaaacatcagcctcatctgtataagcacgtcttcattcaataaaacacatataacaggcctttgctaaacactcgaggtaaaatggcaaacaagacactttcttccctcaagaagttcacagtctgataaggaaaaaagcaaaaagaacaagtaatgacaagttgaactcctgaatattctgacagatcaggcaattcacacacacaaaaaaaggaaatagaattgccgatattataaaacaatctctaaccttcccattcattgaaaaattttcaaactaatactacactctcttccaaccatcagattggccaacaaaaataaacattgtattatcaaccgttagcgtgaggagacaactcttagagcccaaatcgataaaaaaaaaaaaaaaaaaaaaaaacttagcatctaactaaattttaactgacgtttcatttgaatcagcactttcagaatggctctgaactacttaaatatatgtataaaagccaggtataaaggtatttgtggccgaccatggtggcttatgcctgtaatctcagcactttgggaggccaagacggatagatcacttgaggtcaggagttgaagaccagcctggccaacatggtgaaaccctgtctctactaaaaataaaaaattagccgagtggtggcccatgcctgtaattctagctacttgggaggctgaggcaggagaattgcttgaacctgggaggcagaggttgcagtgagctgagattgcaccactgcactccagcttgggcaacagagggagactccatctaaaaaaaaaaaaaaatatatatatatatatatatatatatatatatgtatatatatatatttgtatatatatatgtatatatatttgtatatatatatttgtatatatatttgtatatatatatttgtatatatatatgtatatatatatgtttgtgtatatatatatgtatatttacatttactactacacagttggtaattaatgaaacggaaaacctcagtgttcagcaatagggaactgctttaatgagagcagatagatccatactaagagataatatgcagtcataaaaaagcaatctatataaactgatgtaaaaagtatttaatagctattaagagaaaacctacctactgaactgtttaagtgtatatatagcttgcaaatttggtagaataatttaataatcaaaatgtgtggctaatcggggaagtcagggcttgttgagatagtaacaggctgcatctcctatttcacttcagttgattccatttttaattatttttgtattttaaaatgactattaaataatatgagttaaaggatgtatacctatttaaagactatccactgagaaatctcacccttaattctaaagggcgctgcaattcagtgatcaatagaatgaccaaatctccaccctcaaagttccttggttattttgaaaaccgtactgctaaaaagagaaaaaaaaaagtgtcattcttttctgcctgatatcttcccagcatatgtaaagtagtattcctggtgatagtatctgaaaatcaacataatccaaaggtcctcactttgtaatgtttgcagtaagattccagcatcttagcatttaactgttttcagattacatccatttaaacatctgtgattcattatcgtaaatatcacagttgtggggaccatatgcttcagcttgcagcatatatgtgtgtgtgtgtgtgtatgtatatatatatatatatatatatatatatatatatatatatatataaagaaaaagcacgagcaataaatctcaggaaccttagacttgccgtgggtatgtgcaaaaagaacatttccaaacacatggggctgtctataatcacagtaatgtacttgagatcccatgtaagaattattcaattgcaaaagttgccacttgtgatggaaagctatgatttacatttggcttgtgcacttcccatgataattcaaatagggtggaaagcagcacaaaagccttctgctgcattggcttttacttcttaaggaaatatgtgagcgctattgttgtcgagtggagaaatcacagaaaaatgagatacctttaacaagtggcaaggcactcttggcaggcatccttcattcccatgagactggagctagagatgatgccatatggcctaagggatgtaataaaaatcacttggccactggaggatgaataggcatggcctacagggctgattattttcttgcttacaccagaaaacccacgtatgcacacaagaattaattgtgcttcatgtattgtaagccaaatcattgtcttttaatttcctgataaagtcttgtcaactagacagaaccaatctgtaatcacagctgatgagtatctcacacactgcaattagggaggaggtaaatgaattaattggttacaaccaaaaggagtctgctaatattttttgattgccaactctcttctagggctagcaccaagcctagccagagatatggagataaaactgtaggaagctcttgccctcaaggatcttccagattaccaaagggcaggttaggtcaggagaaaattttcaaggtgtggaagctggccttctgcagtctgctgcagtttgattggcatccctgctggttattatcaagccaccaaccttgtcaaagccttgtgcattccctttaggaaggagatccattgttgccttagatggtgttcttgagcccctaaacactaccctgccatctagaaacatttctggaccctgtcctggaatcaaggtagcacaaggccatctctgcttagaagcattctagatatccacaaggaaggaaggatggggtgtttaaaatgcttttggatctttttgtacaaaagatgctcatctacatactggctacacgtcatttatgacatttatgaaaaccaaaattgacattctgaagtccttggatcaaatttctgtgctgttcttttctcctccatggtgttttatttgatgcgatcttgggatgtgtgatgacttcgtagtggaatagcaggtgttgatccgtaggaacttcaaatctcaagagttatttgataaaagttatagacagatcaatgatagcaaatttcaaacttatgtttccccagtcattgaagaaagaacactagtaacagctcttgactacatttaggtgttcttgactatctttaatgggtgcataaggatttgcctgggccccattcattcattttccttgaccctcttcagagcttgagtgtttcctaagctttgacacacagggtcttctggcatctgctgtctggatttttgctgatggatttaattactgacttcaagattctactcaattccattttgacaccttttttagctcaagacacagactctttgactccctgttatgtcctgtgctgctaagctgtagaataacttcgaacatttactttggataccatcatttgaaggaatccactctctttcccaaggacctggaactggattctatattagttgtaaaaagcaatccagctttcctacttacagatgtgtgaccttaagaaatgttcttactctctgagcttcaggttttctcccctaccttcatgatactgttggagaattgaaagaaataatgtttatcaagtatttagtccacggactgacatatagaaaatgcttcataaatggtaggtattatatatgatagacatcaaacatgaaatactattagggctctgtactattagcactattagggttttgtagagtgacttgaatatatagggaaacaattcatgtaatccccaaggtgtgttcatatgaaccaacacgctttgatgccacagccatttataccagctggaagagtgcagaactaacataaatgatgtcctgctagcatctgcagctgggtcataaaccaaagcttaatgttttacaaagttttgatatgcagtagtcaatttatccatttttgtgaatcaagtaggttgggaaacaagcccagcaaaacacagtttggtaaattttatgtgaaaaaactctcttctttttcactcagtaatttttgcattttaaaaaaatacagtaatcaaaagaaatatgatgggccagtgaaaagcctggcctttggagtgtggtgaacctgagttcaaaccccagttctacaagtaaacctttgcactatgggtggctcagtctctcccagcttatctcattttgcctctgtaaaatggttgaaatatcggattatggggattggagtgaaatggaacactgacccttcaacatgacagccctgccaataattatggggtctaagcttctagacgctaagtatcatgaaaatagatgctattccacattcacctttagttgccgtttatcccttactgcctactgtcttgtacattgtaagtgaaaaaatgatgtttttaatgggttaatggatgagtatgttgaactttagaataacagaatttcccagttgtaagagacatcattcaatgctggaattgcttccacaatattcctgatgaagtcatataggttccacttgaaagtacccagtgacaagcacattatttcacccagaaggaactagatcttccaaatggtaacctgaattgctttaggcccctccagtatggtcatgcattgtttaaccatagggatatgctctgagaatgcaccactgggtaatttaatcattgttggaacatcacagagtagacttacacaaacctagagggtatagcctattacacacctaggtgatctcttacaacctatggctcctcggctactaacatatatagcacggtgctgtactgagtgctataggcaattgtaacacaatggcaagtggttgtgtatctaaacatatctaaacacagaaaaggtataataaaaatatagtctaaaaggtaaaattggcacacctgtatagggcacttactacgaatagaggtggtaggattggaagatgctctgggtgagtcagtgagtgagtggtgagtgaatgtgaaggcctaggacattactgtgcaggactatagactttataaacactgtacacttaggctatactaagtttataagaaaaagctttctttcttcaatcataaattaactttagcttactgtaacttttttactttataaactttaattttttaactttttggctcttgtggtaacacttagcttacaacacaaacacattgtacagctatagaaaatattttctttatatccttattttatagacctttctatttttaaatgttttctctttttctttttcacttgttgaacttctttgttaaaagctgagacatgaacacatacatttgcctaggcctacacaaggtcagaatcatgaatatcactgtattctgcctccacattttgtctcactgaaaggtctttaggggttataacacgcatggagccatctcctatgatatcaatgccttcttctggatacctcctgaaggacttgcctgaggctgttttacagttaacattttcttttttttttttttttttgagacagggtctcgctctgtcacccaggctagagtaccgtggcccgatctcagctcactacagcctctgcctcctgggttcaagtgatcctcctgcccaagcatcccggttagttgggaccacaggcaccagccaccccacccagctaatttttgcatgttttgtagatatggagtcttgccatgttgcccagtatggtctcaaactcctgggctcaagcgatctgcctacctgggcctcccaaagtgctgggattacaagcgtgagccaccatgcccggccagtaaaccttttcttaatgggtagaaggaggagtacactctaaaaaaaaaaaaaaaaaacaataaaaacgatagtatattaaatatataaaccagtagcatagttgtttattatcattaccaaatattacatatggcacataattttatgtgcttgacttttatgactgaaagtgctataggtttgtttacaccagcatcaccacaaacacatgagtaatgcattgcactctgacgttatgacagctacctcactaggcaataggactttttcagctccgttatcatcttacgggattgctatcatatatgtgttcctctgtagatcagaacatcgctatgtggcacatgaccgaatttggacaaatgtgacgtcatgcaaatatgaatatttgcattgttctggcttgtagccccacacctgcatagctgtaggacctcaatgtattctccttcctggccttttattctggttatttctggaagacctcagggcatctgtcacatgaattcacaaattcttcttccatgtcctctcattctggcctctttaattattaacattcctgggaaactcttggaggaagggcctccccactgccctctgtgggaaaagtccatctccaggatccccaaagccatgtacccctcaaggtgccaacagaccctatgactgctctagtgttctctctaccagaacaaagccaagctgtactccactcaaaaatggggccaccctgctgctcagcataacagtttgctattaggaaacaaaataacagtgcttgaaaatacctaagttgtctgtggtttgtgaatctttgagttgtgtatgtagctttcttttctctgaactatggatccatggggctggcctaggaaaccaatattgtgttcctctctctctttctcctggttctgcctccctctctaggtgctcatgcagaagtagtcctcctcagaggcccccttcctccccaggtatatctgctcttgcaatagagaggtaactgggaaatcacgagactgtcaaggcatcaaaacacaatcagggtctgaatcccaatttaggcttagccaggacactttgtcacatgtccctagacaaccccaactgcaaggccaaacaccctgaaagttgcagtggagtaaagctctcttcacattaatttacccttgagatgcacattcagaaggagacttttacacataattgctataaagtttaaaaactaagggccttgtcagagacgtgtgccagtcatgaaaataccaagaagggatctctgtaaatccgagatttggtgattctcaaacttgctgaatccatgatttttctttcgcttaatgggtgactttcaaatccacttactcaaatcttcacttgagttgatgccatcattctcagttgtgtttggggagtttcaaatctgcttagctgccaagttgcagttctgctatttattcattcaacaaacagggttgagtatgtactgtgtcaagcactgtgctatatataaagtaattccaatttgaaacacaaattcgtagtgattataaccaccatgggatagatgatgcatagcattctatcaggaaacaacctgccatgttttaaggaatccacggcaagaggagaacgtaagactgacacacatacaaaacaaagattcaaagctaacggctcagtttttaatggtaggtggagaaaatcccctgaaagcagatgtggcctctgtctttttccaagaggaagcccttaagggttacatggcaaaaataggtttctgctgaagattgttggactgtatcattcattatgatatcttctgctgacatgatagaattgaaactctattttatcaaagttggaactgaagcatggaatggaattaagactgttttatgtttgttctgcacttaccaaattctataaagcctttggaagtgaaattcactcctgggtcaaccagtcatggctagaatactcccagaaccttatagaagctctgcaatgtcagtgctgactctaggccaaacatggaacacggaagcccaatacgcatgttcaggaagcagaagagtagaaataatcaagtctgtagggtgtgcttcttgattcactcatggatctgacccaatgtgggtggaattgaacgtatgttaatgaaggcttgagtgactagaatgctggtgaaatgagagtattcaggaaagtcaaaagaaatgcttcctgtttcttccatttggaccagtctaaagagactctggactaagccctgtgagtgctttaaaaggaaggtggtgcctctggatgccagtggcatactgagggatatgaaaagcaattaagtgatggcctgtatcctggaaagagtctgtctgatatttctgaattaaatgctactttagttgtcagaaagacattgtcatgccccagcaaaggctttgcagattaaccaatatgcaggaccttcatgctgaggaagaattgaattctgtttttccaagtaggcaaggaataccaggatagctgggtctctccatctcaggcaaaacagacaatctacattcttatgctctggggcagttcctatctgtgtcatgtccttgagacagctagtataggtacttctgagagctggtaaaaattttagaaaagttgcaagccaactgaaggcacattggtaccttgaaataaacaacgtgtagagcatttaaaccacagaaatcggcagatgctacaactcgagactttttccaagactagcacatcactgcaagtccttctcttctgtgtgtgcgtatgaagatcctggaggtggatctgtgcatatctgtctgggggagggctacaacttccagggtgactgattcagagcctgtaattctgattcatatgcatccttgcacacatgtacaagtggaatctgaccatccactctgaaagggccccacaacttatgtgcagacacatttgcaaagcctctacaaatacatgcaaactctaggacaatttacccatataagatgtgagtgtataaatcacagattggcccaagcacgcttataagaatagcacaaaattcatatattagttcatacctagctctgcaagcaggactgttctatatttggcagataagtttaaatccatctgcatttcattttttctgggatcataacagagcttaattttctcccttatccatttttagatggtaggaaatctatgccttttggattttcatccccaagaaccaccttcaaaagaaagaaatggaaaagcataaaatcaaggtcgggaagattaagccccttaattcacatgtcaaacttgccatttcaattgtggttttgtctcccagctgaagtttgtctttttgtgacatttgcattaagcccaggggacattttgagtggaaaagcgctgaaagcataattgaaactctgagtgttgccttttgtctaatttgcaatttcccccaggtggggtgttttcactaccccccgactccaccccgccctcccagggtgttctaagattatctcaaagaatgatgttatgcaatttattccaataaatctccatgtacagtatcttatatgtgtatattttttgccttccagaagttatttcaaatccgtgagaaactatgtagggaagtcattcataggttcagaagagtacagatagttcatttcccctttcagatagaggttttgagtatttgttcacaagtttaattgtttagtcacatctttcagttatccacatggtgtcattctgagccacccaggaagttgtctctatagaaacaagcattttttaaatggacataaactgttcagttttgtccttaaatatgtctttgaactctgtgctcaattcacatatggtcttgatatctacttaaaagtttgagaatcactgacactttggtggcatcaacaaagtcaataacatgaaacacaatgcagggctgatgtcatcacatgcaccctttaataggaaatttaggatatgattataattggtgagaatgtagagtctgttttctccaggagaaagaagaaaacgtaaaagaaaatgttgtggcttgtttttcttttgagtcaatgtcttcctgtttatcagagctgtcctttagatattgccaaagctatggcaacaggagcaatttagattttgccctttctagaatttctgtttttatcaagacttcattatttatattaaataaattatttcttatctgatatttggatatcatagccttcctggattatatacctgagtagagtggatgcaggcatgaatttgtctaactgagggttggatggcaaggaatgtagtaccagccagcatttccagagggtacaacaaacgtcactgtggaggttttagtggatacaaggacaaacttttttagtggatacaaggacacacttacttcttttgaatttggctctttagatttattttaatatttatttgaaaaaatacctggcatattcaacaggtattataaatactacattcaaataattttataatttaaagggtcagtcagttaaaaaatattaagtaaataatcgatgtggtatgagaggtggcaatgaaattgtgagtctggaagctgaatgactaaaggaaagaacacattcatctagaaagactggcatagccctcaggagtgtgggctctagaaccagaaaccacactcccgagtttggatttgacctcggttcatataatgacttcgtggcctcggataactcatgcaacctcactaagtctcagtttccacagaacaccaaaagttcctacctcaaattgatgatgtgaagaagacgacatgaagatttattgcaatcattagtgtaaagctcacagtgtaatgtaatgtcattactttaggaaaactcttgccttacatttgtacgaagttgtcttcaccaacaatccgtttggagaatatcgaacaaaactttgttgattctattttgagcagggctctgtaatttcactcctttaatatcgtttttccttcacaactgttcacatgaagtacgtagggcttcaccaaaacaagtgaagggattcaacaatgggcaagcctgaatcagaatcatcagccccacccctttaaccctagcagtgatgcctgtagtaaccatttccatggcaacagcctgagactagcaaggtacctgactagaaggaatgacagaggaggaggtagaaaaatcagctggaagaaggaagctgtgtaggaaaaggaaaaggtagcttccttagtgcccagaattatggcaataatggtgatcattctcattcatggagcaacaagctctgtcctaagtgctttctgtgtgtaggcatgcattatcttgtttacacatgccataaggattatagtacctttcaggaggatgcccactctatggataaagatgtcgaggattaaagaatataggtggtatattagtccattctcatgctactaataaagacatacctgggacagggtaatttataaagaaaagaggtgtaattgactcacagttcagcatggctggggaggcctcaggaaacttacaatcttggcagaagggaaagcaaacacatccttcttcacatggcagcagcaaggagaaatgcagagagaaggggaagaatgcccatcagatctcgccagaactcactgtcacaagaatagcatggaggtaaccactcctgtgattaaattacctcccatcggcttcctcccatgacacacgggagttataggaactacaattcaagatgagattttggtggggacacagccaaaccatatcaggtggtttgcccaacgtcacagggctcctacacacaagccaggattagaaaagggcttagaaacctacccttaaaacttccctttcttggggcacggaaataacagttgctggcatgccagtccccaacctctactcttttccaggaatggctgggaaatgtggagacctggcaccttgacaaagagtttataatgtaaggtcctggttcctggctctgtctgcattagattaatcagggggagcttttaagagatactagtgcacacagaccgcaactcagcacagttgtatcataatcttgggagagagtgggggcaggtattgctattctttttaatgctccttcagcatttcttagatggccagccttgagaaagaaccatggcctaaagcacctactcctgagttggtaagtggtatcaaaaatatacaaagacccaattatgcaactgttagctatttgatttagaaagtattgagtgccggtgatgtgccaggtcctgaaactgcagttgttctcagtgtgacctcacttggtacctctgatgatcccaaaggggtttgtgagatgcccaagggggccatgttggggcaactgtcctttctccacttgcccatctattcctaggaagcagatgtgcccagagcttgggctgtagaggcagaatgaacagatcagagaaggttctcgctctaggcctttctggatatgggaccacgagctagtcagtcaatctctctgagactcagtctcttctcctgtaaaatataatatgatgcttatatatttatagactgtgcattctcattggggctatatttcccccacaggggtgaaataggttcgagggtggggggacaaaaattgcacttacaaatgtaaagtatagatatacttgtagtacctaaacagatataagtatatctgtgatattaaaattttacaggaatagtggcaattagaaaaaaatacttaaaagagcccttaggggagtagataatgaaaaaaacaaaagttaagcaaccctgctatagaattgctatgaggctgaaaggaggtatggacttgtacagtcctttgcatagagcgtagcactcagggaccactcaataaatagtagtgccatgactgttgtctgtccaagcatcacttcattcaaaatgcacacactgattccaaccattctttggggctatgcaagttttactggcatctttgggacagataaggcaccacctctgacttcaccaatgagctaggtcagagctaagcagagcggctgagtgccattctaaatggatacacacggggtccaggggccaaggggagagcatagctgagttcttcatttccttgtactccctgctgctgggttcaatgaaatcaagaggtcactacgggcctcttatcccaattcacagccttgtcggcagcctcttgctcacagcacagaagggagaccccccccccccaccgccccgcctccaatcctctaccattactaaatcatcattttgctctggagagtaactgagcaaagtggaattattactgatggcctcccatgtggaaaaacatgctgttcattgctgaagatgtaaagatgaatgaaagaacaagactcaatttctgctcttggttctggtgcaaaaaacaaatacataatatggacagattgatataatataaaaggttctatgggaaggaaattctggaacacaaagagaatgcttgaagaagttgcttgagttgaatcttgaagagtaagcaagagttaacagggtgaagaaggtgagaaatgccttctgcagagagggagcactatacacaaagggtgggacagtagagtagggagatgcaagagtgggtgaggtgtgagctatgcagtgaagacaaaggcagaggggaggctgatggacagcctagtcatggaggaccttgagtgctaagtattgttttgcaatgaagatccataattatatgagactcaggtggagaaaagctggtcttatagttgcaacaggagaatccaaggcttcctccagggagcagagctgtgtggcccccagtaccccacattgcctgggcttagcttatctccattctaacttccttcaattctcccttgctgtctgtgccaatctaactgcttacatccagttcggtagatgccgcaggactttgcatatgttatggttttctctgcctaagtaataggtccccaattatttataagagtagtaaattgatgtctgtcttccacattagacttcaaactagggactgtgcctgtctttgttcaacattataacctcagcatctagcataatgtaggttctcagtaaatatttatggtaggaagaaagggtgggaagaagaaacttagctgggaatccagaacccccacaaactttcatatgccttttcctctaccccattcactccccagctgagactgtcttctgtgatcctgttcgagggttaagtctggaacctcatgctggcgattgaagcagtcatttcctgtgaggccttgtcatttgagtaatttgcctccagtggatgaatactaattgatgataacagtgaaagcaaccttggtgtcacttcttcatagttcacttccaaaaactgaaactaagcatgttcaattcatctgggctaccaacatggttagagaaagtgagcaagtgtctgagaaccgcagggtcctgagagtccacttgtgtgtccatgcaaagatggctctaaagctgacttaaccacggaaagccttagaacctttgcagagcgatcaaaaggcaccgcagcgtgcagtgctcttcaggactgggcaggaacatgaaaacaggactgagcagggcaatcacagctctctacagtagtccctgcttgtcctcaggggatgtgtcacaagacctacgtagatacctcagtccgtggatactacccaaccctatatatgctaatttgtcctatacatacatagctatgttaaagtttaatttacaaattgggcacagtaaaatattaacaacaataactaatgataaaatagaacaattataacaataatgaaaatggcacacaatttgaaacttatgaattgtttatttctggaatttcccatttaatattttcagacctgtgttgaccatgggtatctggaattgaagaaagccaagccatggagatgggggaactactgtattcaggttttgataggatttcagaagggttgtattctccatggggtattgtctttattgaaaatgtgcagtggtgacaggcaaatggtccagggttcaaatcctggctcatcatttacaacctgtgtgtactgggcaccaactttgcactccatgagcctcagtttccttatctagaaactgtaggagaaggggatcaaaatagtactttatttgttgtcattgtaaagattaactaaggtgatgtgtgcaaagtgtgtagcacctacccttgaatgtggaaagtgctcaatctgcattatccactattattatcagttaatatgattattatcaccctaagtatcatcttcccagagtagaaatatcagtttagattttcagatatttatatggctttcacagtgtgctaggacctatgtagatgagcttagattctcagatatttatttggctttaacagtgtgctaggatctatgtagctgttgttaccaaaagatgtacacaagaaagttcctagcaacaatatttggagccccaaagtggaaatagtccagataccagtcgagagtaggatagataaagagactcaatacagccacataatggaatactctatgatgattaagataaagataaatatagtaacctggatactatacagtgatcagtgattattgttatagtgattagaataaactaccacaactcacagccacatgatgaatctcgtggcatgtaatgtcgaatgaagaagccaaataggagagagtgcatactgtatgaccacattagatgccatgcaaatgcaggtaaaaccaatctgtggtattagaggctagaataatgtagcctctggggaagaggttaggaattttactcaggaagggaggggactggtaatgtgtcatgttatggcctggttgctggacagttggttgtgcttactttgtaaaaattcattgggttgtatgttctgatttatgtgcttatatgtgtctacattatgcttcaattaaaggtttactaaacaaataagcctgttcagcagagaccaaaaagcacgtagtacaattctatgcttacccacaaggggcctcaaagtttacaggaggaggcagacaggcaaatgcatgcacagataatgagttgtgatacccataataatagaattgtgtaccacatgcagaatcaccattgaggggagcatgatcagccgtcacagcctctgcttgtgtcaatgccctgtgctccatttgttcatgcagggggcccatcttccctattccttcccacacatgaataaggtattccatggcaggaactttgctcacatctgtccactctccatatcagcaccactgccttcattttgtacagccatctttgatgcaacactgaactcgttggaactgggtctcttggcctctcttcctgcccttctttaaatcacttgctataacccagatctgccaaattataatcattgtattgggtcctctggattcttaaaaagtaccctgtgggccgggtacagtggctcacgcctgtaatcccagttctttgggaggcctgaggtcgggagttcgagaccagtctggccaacatggtgaaacccccatctctactaaaaatacaaaaattagccaggcatgatggcatgcatctgtaatcccagctacccaggaggctgagacaggagaatcactggaacccgggaggcagaggctgcagtcagccaagatcgcgccactgcactccagtctggatgacagagcaagactctgttaaaaaaaaaaaaaaaaaaaaaaagcaccctgtgtgattctgatgcaccccaatccttgagaagcactcctcttcactggaagcagagcacacacctgatcttgactctctccacacaacaaatcgtccagggctaccagaaagcaccataacttactggcttttcccaacttgtttcccagagacattttcagcctcatttccacccttcccttctagatccccaccattctagattcccaccatccctgccccgttttaagtttgcctctattcacctaaaaacatatggactattccatatggactgagcatgaaagaaatatagttcctcaaagtaaattaaggagctgttttcagaggaaaggaaatggatggtggataggcaagaaaatgtggcccactagaattctatatggtgctgcatattgtgctgtatacatatatggtgcatgcgtatgtgtacatatgtgtacatgtatacattacatgcacatataccatatgtgtgtatatggtgctgtaggtatatacatgcgcatgtatacaccatatacatgcgcatgtatacaccatatacatgcgcatgtatacaccatatacatgcgcatgtatacaccatatacatgcgcatgtatacaccatatacatgcgcatgtatccatgcgcatgcataggcatgtatatatatgtatatgtatacacgtatatggtatatacatgtacatgtatatgtatacacgtatatgtatatacatatacatgtatatgtatacacgtatatggtatatacatgtacatgtatatgcatacacgtatatggtatatacatgtacatgtatatgcacatcgttaattctcattccctgaatctgttttgctatttagccctcatccctgtgcctttgaatagcctataatgtcttccacattcttaagggccttctcatctcctacttatcttcaatacccagctcaaatattgactctgtgcagctctcctcaatggtcctgagcaccctgtggttctgctcagtcacccacacatgccaggattagatcacttccctcaaatgtcactctgccagatctgactcttcactccactgagaaggcactcaagtgtgcacactcagagcttagcacctgcctggaacatgcgagttcgtcaaggacatgtcttgattgagtgaagtccatcagcacaaagtcacttgggcacaggcatcttgctgtgggataaaacgtaacatttgtgaactctgggttgggaaactatgtggtaattcacacttaataggtcagagatatctcagagataagctgcccaacctactcatgctccttctgttgtttcgtttgtttcccagtgaccttcagtgactgtaagggaaacgacaagctacgctatgaggtctcgagcccatacttcaaggtgaacagcgatggcggcttagttgctctgagaaacataactgcagtgggcaaaactctgttcgtccatgcacggaccccccatgcggaagatatggcagaactcgtgattgtcggggggaaagacatccagggctccttgcaggtaacacatctgtttgagataacttgggttcaaggaggacattaggttctgtctgtcttatgtggaaaatgggtctttaatttattatgttggctaagattccttttgttattgttgttgcaaatgacagaaatccaactctaaaaatgtagatgaggggcagcgggaattaattgattcatgtaactaattgaggcatagttcgtggattaattcatggaactattttagggatacttctgccttcaggcgtggctgaagctgtccaaatcagctttaatccctgtgcatctcgtggctccattttccttttattagatgtattgagacagtcacatctctccctgcctcccaaggtggaggtctcagcaactaccctctttctgctggtctgaagtcgcctgagaaagcatctcttcaagacgatgctagcaaaaccttggaattcagtctcgtaggttagatcatgtgtccacccctgaactaaacatggtgtccattgggttgtgatgttctggttggccacgtctcggtcacatttcttttcctgaagccagggcagagtcagccctattcacctgaaaactcatggactgagagtgaaagaaatgtagttcctcaaagtaaattaaggagctgttttcagaggaaaggaaatggatggtggatagaccagaaaaggtgacccactagaattgtatatggtgctgcatattgtgctgtatacatatacggtgtatgtgtatgtgtacatatgtgtacatgtatatattacatgcacatataccacatgtatgtatatggtgctgtatgtgtatatgttgtacatgtatgtgtataccatatacaggcatatgtaccatatacttatgtgtatatgtacacatacatatggtatatgtgcatgtaatgtatacacatatgtatacatccacatttaatatatcaaagatatctcaaagctaacctgcccaacctactcatgctcctcctgttgttttgttttgtttcccattgaccttcagtgacttcagtatatctatgtgtgtatatgtatatatgtatatgtaattgtttacggttctgtatatatatacggtgtatatgtatgtctatatgtatacatttgcatttaacaggtcataggtatctcagagataagctgcccaacctactcatggtccttctgttgttttgttttgtttcccaatgacttttggtgacttcagtatatatatgtgtgtatatgtgtatacgtatgtacaggcatacacatactatatatgcgcatatactgtgtatatgtatgtgtgtatatacatacacatggtatatctgtattatatgtgtgtgtaattgcatatcgtgcttctcgtttgccaggcagcagtgcttgttcccttccacaggcacatgcatgcagatccctgcactcccacacatatgcatacactttataagtgtcacaaactgccattcaggcttcccgattgtgccattcggagactttttgctactactgactcctgccttcttcaccaggagctcagggactccaccttcgtgagaaaaggagggcaagacacacagcaggattccagccaaacaatgacttaatgatggcatgcccctgcttggcatgcctagccttctctcctacctgcgagcttggtcttcctcgatttttcacagcccctaattcacatcccttttctccacctgccatattagccacatccctgcttgatctactcattttgttcagtggtggagcgagtgtgggtcacacagctgggagcagagacagtacaactggcaatgtgagagttaccttcccgccagtgctgtctgtgtgatcttgagagcatcatatagcttctttatctgcagaatagcgaggttaaacagcctgcagtggcaaataagtggctcatgtgccaccctactgtcaccgtgctcgtggcagatattgctaataacccctggcttagcctgagtatccttctcactgcaatgcttctggaacctactatcaattgatcatttagtggtgtttctgagggtggaacctatctgccattcctgggctggatgaacttcacaattccccttcagcatctgtgaagctgtgagttaaggatagatggcaacctaaaaacgaatgtacggcacgtcagtcatgtttcagaggaaactggatattggtgaattcataccagtgtggaaatccattgacaccacaaaggcaagcttttctcttacttagccatgaccaatggtcacagcatctcactaatctgtgatataaattatgtggcaaatatctaaagcaacaaagttgccaggatatacagcaaaaacaatgttccatagaaacatggaaatggtatggtgagggggtttgcccatgggcttgaatgcatttagatggcgattgttcttcgtgaatggtggctcatctttctatctggaaaagatactgtcatcgtattttgcttcaaagagagcagaagatcttctgggcaggttctcgggaccaaccccaccttgagggcctgggagagctgggttcattatgaaaactcagccacgcattgtttgtacctcaagtttctgtgagatgccatccagagacaaagctcccctgagtcctggctgtttctcgcttgctgctgtctgtacgcattttcgacaaaacttgcctgtgattgtttttgcttcttataaagggggcggaggctgccgtgtccttcagtttgccagacttcagcagaatggggcattcatctcccacgtccagtaattttatgagatttgaaaaaaggctttgtgaagatgtgtagctgtgtccttcataaaaacgcctcaaaaaaggaaaaaaaaataaaaagaaaatgaaggaaaacaaaatagatagcaaaagaatccctctgaagagagcacatacctcaatggatatgcacgtggtatgtttgcaggtcctactgtgtgcagccaagtgggccagctgctagagaagaaaatcagtgagtgcctgagtcagctcagctcctgttggggagggaatacgaatgtgtgcattgatgcttgggtaccaggcggggagctaacagtgatggatgatctctgcatttggagaggggagaggtcaaggggagctgggctggtcctcaaagcaccaaccatgtgccaggtgttgctccatgggctacaaatgctgactcacgtaacctccttagcaactggaggcagatgctactgtgttctgcctcatagtgagtttttactgattttactgatggaggaactgaggcacaaagagccaagtgacatttccaaggtctaaaaatgaataacaagctggatggaagtgagacttgagcctgggcagcctggcccctgagtccgtgcctccaacccctgcatgagctggactttgaaggacgggtcattgtgcatagttgggagggtctacgagggaaatgttggcctgtcttcatggtgtttctcttctaagctgtgttaccttcagtcaattgctttacctcctgagcctctatgtagttttgattttttcgtctgtaacatagggataatagacttgtttggatcttcctgtggattcaatgagacgatacatgtagcagtaatgtatagcactcagctgatgctacagcaatgaccaacactgatgcttacgtaatacttactatgtgctaaaccctgggtttattcaagtctttcatcctcacaacagtatgctaagggaagctgttactgttactggtgctgttatcatttgcatctactgggtgaggagactgagacacaatggggctgtttcttgctctggacacttagctagtaggtggcggaagagggcctcagaccttagcagcatggctctggctctggagctctcctctttttttttttttttttttttttgagatagggtctcagtcctgtctcacaggctggagtgcaatggtacaatctcagctcactgcaacctccacctcctgggttcaagtgattctcctgcctcagccttctgagtggctgagattacaggcacccaccaccacacctggctactttttgtatctttagtagagatgggatttcaccgtgttggccaggctggtgttgaattcctgaccttaagtgatcctcctgcctcagcctcccaaagtgctgggattataggtgtgagccgcagtgcccaacctggagctctctgctttaacagtaggttctattggctcaccatctggaacagagtaaacctgcacaatgttcactcccacaaatgcagttacaacagaggcaagcaaggcctgcaacccagaatgccagattgtcaggaccagctcagtgcccttcccactttccctcttcccgtggctgaacctgatagaacactcctgtggctgcctgtaaattctgacccttgatatctggctcccactctgcatccctctcccttgcaccctgtgttctgcttcttcccagccctttggttggtgatcttgtcgtgcagcctagatgcaattcatcttctcattctcaggcaggaaatctgcagttcccggagatgatttggctccacctcaaggattagcctgcacacccatacaccccacacaagccagggtccagcatcccagggtccacttttcttggccagaggaagctggaacagaaagggaatgctaaataaaagcatgggaacatgtgggcagacaggatggagacagcatctgaagaccaggaggagggattctagattgatatgacaggagctatggagccactgtaggttcttaagcagagaaacaggcaggataaaaatagtccttggtggtgttcatccaggagccttgactggagtagggagagactagagctactagttgaaataatagctactactattttttgagaattgatttcatggagctttcttacggtcatgcatcttagtctatgtttagcctatgttatttctaattctcacaacctccctgtggggttaccgagattaccccttcctgcagatatgggaaccttgccaagagactctaacttgaaactgacaaaaatgagattgaaattctggcctctgcctaaatacccattctccttcctgccactttgctgctagaaggctgtgccactggggaggctgctgccattgcccatgggtctaggagatgagagcatcagttagagcaacatgggagcaatggagggaaaccagaagcaagatttgccagaaaggaagaaagagccaggatcccgtatctggatgattccagattgtctagcctggaggatggagatgaattggaccagtcaggaaagaaatgttagggaaagacgtctagtcaggcttgagtgtgttgatttatatgctcctagggacatctttatagagatgtccaggagtcaatggacaatgtgggactggctgctagagtacaaatttgaaggaagaacagcatagtggtgggagttttggcttatgttggacatgagtgggttcaaatttctgctatgccacttactcattgtgtgacttgggcaagtgactcaattatctgaatcccaatatcctcatctatcaaatagggataagaacagtctgtgtcacagagttgttctcctgggcatagcaccagacatcaagggacagttcccatcaatggtataattttggaacctcaggaggaaggataaggaactgagggctaagtgtattcactgaggccctgagacagaagccagagatggggaacaggaagagaaagtaaagccaatgaaaagaaagggaaggcatgctcagagaggtaggtgggaccgccagcctaaccaaaacaggggcgatttcacacttgctcatttcatgtcactgtgttttggaaggaaagattctctaaggcaaatataatcacagttaagcctattttagctgtggtaactggagcctggctcttctttaataaaaggagcctggcctctcttatttttacctgctacttatgaccctgtctcacctgcaaaacatataccccaaatctgtgaggtctgattgttaatgacttaattatagactcacaagctatttctgcatttttaatgggcttcccagaatctagtacctgcctggcttatgtaagatcaccttagatctgagtaggcagaagagcagtttaattccaagtcttttgacaggctctgacaaattgttatggaagatagtgaggttaaccttccgtgcacaaaagggctctcctgtctgtggaaggtcatgatgaacttgacacaccaagttatgtctggacagaatcatgacttttccccaccaaatctgctgtttctcatggcccaacaaggatgaaacgaaaaacagtggatgaggggtctgcgtgtgtgtgtttgtgtgcacacatgcgtgttcgccttgtatgtagtttcaaaagtttacacagaaaagctccatgcttcgttcctcacgcagaaatgtctttatctgccatataaatgggattcaacaacttcattttctggcctggccaacgaaaacactcacaaagtaaaaacaccatacttactctttctttctgagttaagaacttgtagcttgcctgattatagatcatggcaagtaattctgacatcagttaacgaacttgatgaagtcaggttgggaagtgacatcaaggggcttagaggaatttattctgacattgggtttgggaactaaagatactgtacctccaggcttcgtcttgaaacatggaagcccacacactaaacagtggtagaatttagatgcctacggccaggcagctggtccttatgaacaaagcaaaagtctcccatggcccaggttcccacggagagttatgagggccacaggctatatacgcttggatccagcttcactgctcccagtctggagttattcctcaaatgcacctgatcacttcgctcctctgcttaataggctctcacttcctgatcagctcacctggccttggggataaattctaaagacagcatatgtctgaaaaggtcctttgtggtttagcctgactgatctctgcagccttctttcaagtctcattcctgctcatctctaagtggcttgacctgcggaattgtcaccttctccaagagccttcccttcctgtcaccctcgcctcttgtccccatcccaagaaaggatctcccctactggtctcactcttggcatcagtgcttttccttcctaggcttcttctcaatttgtaattatgtatttactttcttgttcaggtgtttaatgtccgccttggatgaatataggaacagtctcttccctgcctccctcccttccttgtttctttcccttcttccttcctgtgtgttcaccactctatcctcagcaccctgcccagtgcctggcgcagagtattcagtggatgccttttgaatacatggatgagtggagcgagttacccctctcacaccctacattgaactctccctccttcaataccaaatcacttgtggtttcttgaattggccaagctttcccatcccttcacactggctactcctctgtctggacattgttccttccactgaggttccacctaccctatggtcagcaccattgatgcttcagaaccagccaagattttccttctttgggaacagctctctgaatatcccccagctggctaggtgttctttctccaggctcctgtagacacctgcctggctctctctactcatagtactaaacaaaacagtctgctttcttctgcttgtgcctgtcttaatgctgagctcctgagctgaaggccctcgctcccatgcagcacactaagatcactctggggccagaccaccttggcatgaatcccagtgctgcatttactacctctgctccaggttcctcagctggaaaaggggttcataattgtgtgaacctcatggggatgctgtgaggattcaatgaatcaacacgtgtgtattagtcaaggttctttaaagacacagaactaatgtgatagatgaatatatgaaggggagtttattaggagaattgactcacatcatcacaaggtaaagtcccatcgtaggccatctgcaggctgagaagccaggaagtcagtctgagtcacaaaacctcaaaagtagggaaggtgatggtgcagccttcagtctgtggccgaaggccccagagcttctggcaaatctctggtgtaagtccaacagtccaaaagctgaagaacttggagtgtgatgttcgaggccaggaagcatccaacatgggagaaagatggaggccagagactcagccagtctgctctttccatgcctggttttatgctggcagctgattagttgatgcccacccagactgagggtgggtctgcctctcccagtctactgactcacatgttaatatcctttggcaacaccctcacagaaacaccggggaacaatattttgcatccttcaatccaatcgagttgacaatcaatattagccatcacagcatccaaagtacttgggacagtcagtgtctcacaacaaactggagttattcatagtgattgcattgttaaatccagacctatgataaatgttcagctaatgaacgaggcaaactgaggtgacccagtcctccatccatgcccaacatgaccaaattctatgatttctgtaacctgtatatattcaggattatgggcgaacttacaccatcaccactcttattcctcaggtgctcactgtataggaagcactgactaaacttcctagagaagaaattatttctacaggtccacttaacaaactccaaaagacctggcagtatttaaaagttcattatgaacaatttacccttcttaactggaagtcaatacaagttgcctcaataaagggaaactggtctcttaatcaagttgcttcaattaaatgcaaaaaaatatttttcccttttttgtcattacaagaatttcttaaaaataaaacaaagaagaaaagttatgacagaagctgaaaaggctaaatttaaggctcgtttatcatgcttgttcatcatcgttgcaaacatgcaatttaaaagacgtaattttggctcctaatccagtttcaagaatcaggatggaaatggttccaaaaaaaaaataaaaggagcaatcagtagaaggagccacttgggagaaacagttgtttttgtttttaatttttttaataaaaatataaaatatatcgtcaattgcccaaaagccaacgaccctgctaatacgtctcttactgcattgggtggttacaacttttaaatccactacctatcagaatctcaggaattatttggtaagtaccttgaggaaaacctggagctaattgccccctgtttctacacacatacattcatggggatatttagcgaaaatttttgtggatgatactaagaggtacctgaaatgaccaaaaatcagaaacgaatcacacatttttcagccacatgatactgaaaagttacgtaacttctctgaggttcagttttctcatctgtacaatggacataatactctggccttgtgtggatgccatcatgagacacatttaataaaacaaatgtcatgcttcattcagtgccttgctaatggatgattcttaatcactgatcaattattcttaagtgaagtagccagtaagttgctatcacttctatacatttttcccctctttcctgatctcacacgttctagacaaaaatacttttgcacatttgttactgatgtaaactgcaatttttttctactctgagccaactgtttgaatcctctgtttgttttggccatgatgccatctaaccttcaagacacccgacacgctgcagacatgtgactttactttatttctttaaaacaagagtgtcccccacccacctgtctgagtaccagtccgtggcctgttagaaaccgggctgcactgcaagaagtgagtggcaggtgagcaagcaaagcttcatctgtatttatagccactccccattccccacattactgcctgagcactgcctgctgtcagatcagtagcagcatcagattctcataggagtgtgaaccctattgtaaattgcacatgcaagagatctaggttgcaccctccttatgagaatctaatgcctgatgatctgtcactgtctcccatcaccccgagacaggaccatgtagtcgcaggaaaacaagctgagggctcccatggattctacattatggtgcgttgtatacttatctcattgtatattacaattaactaataatagaaataaagtgcatgataaatgtaatgcacttgaatcatcccaaaaccgccaccatgaacaccctcagtccatggaaaaattgtcttccatgaaacgggtctgtggtgccgaaaaaggctggggactgctgctctaaataattcctgaaaatgagagcaacaagctcgtggtaaattaattaccttgtctctaaaccgtctcacattgactgggagtgacatggaatctgttgacttgggtgattatatcgatcctgcttacatgaaatatgttttacaacaatcccagtggagaatgaatctgcacatttgctgtgaccataaagaaatgatgagttaaagatgtggacacttaatatgccctgatttaacaagtgtgataacttcaaaaaacctgtgaagtaccatgctccatggcaaaagcctccccaggtactgttaaggaaagttagtatccatttaactgtcacctaaagtggagaaaatatatagcttgaaaattattgtacggatccaagaattgggcctagaattcaataataggctgttacatcttgacacatgcctaaattgttatgtttatgtggctcttagctccaggatactattcatatatagataaaaagacatccttcaattcattaatttaaatagataacagattactttaaggatcagaatctaagaaaactatattctggagattaattttaattgaaattcttgggggaaaaactgatcccatagaaagtatagataactaaaaatggcttctttttggcttttgaaaattctaaattttattttatacaggagcatggtccaatagaaatgtaatgaaagccacgtatgtcatttaaagttttcttatagtcatgttaaaaaacgaaaccagtgaaattaactttaataatttatataataactgtatatatgagtgtgtgtgtgtgtgtgtgtgtgtgtgtgtgtgtgtgtatgtataacagatatatctaacatattatcatttcaacaagtaatcaaggccaggcacaatggctcacacctgtaatcccagcactttaagaggccaaggcaggcggatcacttgaggcccggagtttgagaccagcctggccaggatggtgaaaccacatctctactaaaaatacaaaaattagctgggcatggtggtgcatgcctgtaatcccagctactcaggaggctgaggcaggggaactgctaggtcatgccattgcactctagtctgggcaacggagcaagtgtgactctatctcaaaaaaaaaaaaaaatcaatatgaacattattcataagatacctttttacattcttcttttcatattaagtcattgaaatgtagtatatattttatgcttaaggcacatctcaatttagagtatttaatttttaagtacttaataagcacaagcagtgaatagctaaggattagataggatgctctacagttctacaggaatattgcattttttgaaaggatggaaaggatcattcactgagttcctaccacatgttagaacattgcctttggccttagagcccctcacacatccatctgtttttctcctatagctagcctgttcctatattccagatgcagaagtagctcaggctcagaaaagttaagtaacttaaccagtgccatcatccatcagtaagtggcaggactggaagttgagctgggccttctgattttgtggagtcattgctattttgctaatactgacatttatggcagaactattgtgcttttctatttttcagtaaatttcctgaaatagcataggaaattaaaaagttgttagtaataaaaaataaatccagagctgagcaaaactcctaaagaaattttaggaaggtgggcaagccctgtattgtcatgacacattttaaaaacttttcctgtgaatagaacctttacaaaaagaaccttgtggaaacagcacgaggtgtctaaatgtaaatttctcccaggccagggacctgatctcattcatcttcatagtcccataggctagagaaaacgtcttgcgtttatatttttaaaactataatttacaactttgtttatatatgcattacccgatttaagctcacaacaatgcctggatgcagatggtgtgtttttcgttttctgagtgaggacagtgagactcagaggtgggtcttaggtcgcggtcgtggagttggttgagtggcagccagtgcggccatccacaggctttcccaagtgcatcgctgcagccatagttagctccccagcagctgctcggggctttcacatagatggaatatagtgttgtcagaggtaaatttccagctagtatataggatagaacaagataatgtaataaaatgtacattttctaggctctctgatatgcttctaccctcctatctcttgttattaccataaatcaaatactagtcaattctaaatgtaaatatagggatgataacctctttttacaattcctctcttatctgcaactcccagagagattcacatggagatacttggtcactgccggctttgcggtcggcatgactcctattagagattaaatgacatagagtaatctcaaagtagttagcaataaaaattaatacaaaactatgcaaaactcccagagaaattttaggcaagtagacaagtcctgtgtcatcatgacccattaataaaactttcctcgtgaacagaacctttggaagtagaatctcatggaaatagcatgagatttccaaatgtaaatgtctgccaagtctctctgtaagagatgggttggctgggggcgatggctcaaacctgtaatcctagcactttgggagactgaggcaggtggatcacgatatcaggagttcaagaccagcctggccaagatggtgaaaccctatctctactaaaaatacaaaaattatccaggcgtggtggcaggtgcctgtaatcccagctacttgggaggctgaggcaggagaatcgctcgaactcaggaggcagaggtcacagtgatccaagatcacgccactgcagtgtagtctgggcgacagatcaagattcctttaaaaaaaaaaaaaaaaaaaaaaaaagatgggtctgcatttctcaagggaaaaaaacatctccaatgatgagaaaatacagtgtttgataaagaccatggattttctctatttgattctctgttctcaacacccaaaacttaggcagtaaagaaacaggggaagaggtaccatttattcagtctttttccacccagcacatgggatgatcaaattacatggtctcatccaaagttttcaggcagaagcctgaatgtttgtagaaaaattagcctatttggccctagccaaatacatcctccagtctacccatgttgggcagatgcctgtggacttttggaccctttggcctgggagtgatgtgtgatagttgccagggtggcatctgctgttgggccagactgttggtgctgtttgattctcagcccaattgcttgtttaagcaaagccaagtctagtctcaaggcctaatctcatcatagttgatgttgtctttttttgatggcttctaataaataaatagaaacctcttttcctctggtccataccccttagaagtgccacatttaaaaaataagaggaaagccttcatctcactggggcccatagcagtggcagatattgttatttgctgaattgcttctatctttcttaattaggtaggaagtagcaaccatcaaaaaacaaatattgtatgtaggcggccatcaaaacataagacaactgtttttcttccagcagaaaaccaatttggcaaacacttatttttctttctctatcacacaaagaaagtcaattctctaagaaaaaggatagaaaaagaaaagaaaagaaaacttttaaataatatcccatatatgttttgagaattttatacatcaatacattaaaacataggcaggaaaatttcaaatgcaaacaaaaatcacatcttatagctcttagcaattccttgtcttcaaagactggaggaaatagcccactgggaaggcctttaacagagcaggtgcttccctaggggaaggagtaactacagatatttgagggctactcagaggcaaaagggctcaaaaaacttcagactgtcttccaagcaacagccccagaatgcctcctagatagtgaggctgccttcagttggcctgagattgttgctctgaccctggtgccacccttcctctccaaccttgttacaaacaattcagaagggaggattgtgaaatccttcctgctgctctttctgtcttctgccaatcagagaagactggacatgagatccaagagagggctttccctttccccgatggctacactgtgtctcctgcctcccagctgtttatggaaatcagatggtttcctcaactgtctatctttctgcagcaaatcctttgacagagaatgtgcactgtcaaccaaccccttcatcgagtcaggcaaattaggattcctttgacagcaactttttacaacttccttcctttgaagatataaagctttaaacagtagtagttctccgtgagacccaaggaaaggtctgcagactataagcagactttatctgaagaccacctcctgcccctcactcttactccagaggcctgtgtatttatttatttatttatttttttggtaaaggcctctgctgtgaatttaagtcatctaatcaaaatgcattatttctgtccttgcattgtccattctcgtaaaccgtggttaacacagataattgagacttgagtgcttttttattccaagtcccttattcgatttggcccttgttaacaaagcctagtctgtaagagcgtgaccaccagtcttatttaccttgttatctgtaatttcctctttccctcaggcctttgcgtaatattttctctgcatggaaggggaggataagaaagaagacctaaaaactgaatttttaaaatacaaacagaaaaaaagctccctgtattttcccaaattctgcataaataaaataatatgctccataatggcagagatttgactgacttgttcgttgctataaatctagcacttacaatatctggctgtgaataaataatttcttaatgacttagcaaatgctggagacagaatgaatattgatattaataatgcagatcgtagtcaatttatttagctcaaacgttgtgcggggcaccactttaagtgcatttcttacattaagtcatataatctttataataactctataatataggtcctattttatcttcattttacaggtgaataaaggaagacggggagactatgtgtgaccagcacagggtcatacatctagaatattttggagacatatttttgcactcagactcctcaaaaaaacatttaacaaaatatgttatcttttttgtcacaatagaaaaatatgaactgaatattattacagtaaagtagattcaggttggttgaatagctgtatccaaaagggttaaaatataatctgtgtcgtcctggagaatgatttccgcatgcagaaatctaattgaatttaattgctttcatctcagtgatggagaccaagatatgaacacaagttggttactttgaaactttcataactcaggtattcccattgtacaatagccttgagttttgaaaagaactcaagcatgtataaggattgactgaaattaataaattgatactcagcaggtataaatatgaagcccaatagatgggcaaaagaatttctgaaacacaggatgggggtgatacgaaaatgacttggttgatgaggtattcacgctcctggacctgtgccaactccctctctgcaggttcctgcccttattgctaccctgtaattattcatctttaatttattgctcttcaccttgagcaccactctaaggcttttccatttacctaaagcagtaagttgtactctagtgcctacagttttctgtagctggccttgcgggttcctctgctgagaaaagttcataccatccatttcagttcccttttccatctctgagtacccctaactcctttcctccctctcagagaaagaccgattcttcctccttttcatgacatatcccttcacttgtacccttgaactcactcttttctgcctctttcttcatttcgcatttcccctcacactcttacatcttaaattttccctcctctgtgaatcctcccccagcctccaaacgtggtcaaatcttcccaggcgaaaccaaattatttctccttcaaatcgctgcctcccttccccagtcttgttgaaagccatcttcactcaacatctctatttccttgcaagttcataccttaatactccgaaatggagctcctgtcctcaacattttggtgaaaattctctcttttgaaggtcgtggaaactgaacagctgatttccctcaactgtttcttagtcctgaggctgcttgaagtctctgaagcaattaatttttaattttaattttattgaggtaaaatttacataacataaaattaagcaagcgatacttaattactttctaatgttgtgcaaccactacctttatctagttccaaaatggttctgttaacccaaaaggaaactgtatacctgttaagcatgttctcccttccccagctcctggctttatgtatcacctatttttatatataatataaatgaaatcatacaatacttgggcatttatgactggcctctttttttttttttttttttttgagacagagtctcactctgtcgcccaggttggggttggagtgcagtggtgcgatctctattcactgcaagctccacctcctgggttcaggccattctcctgcctcatcctcccgagtagctgggactacaggtgcccaccaccacacccagctaattttttgtattttttagtagagaccgggtttcaccgtgttagccaggatggtgtcaatctcctgacctcgtgatccgcctgcctcagcctcccagagtgctgggattacaggcgtgaatgactggcctcttttactttgcataatgttgcaaggttcatccacattatagcatgtatcactacttcattcctttttagggataagcaatattcctttatgtggatggaccacaaattgtttacccattcatctgttgatggccatttgggcttttttgactgttatgaacaacactgctaccaacctgtgtgcaaatgtatttgagtactaattttttatttgtaaatacagtgacaataatgccacaaaaacattgcatacttacaagatttatgagttacataatttacaatgattgagtgtgggcagctctattatctggatttcattaagatgatgctacaaaaatagtaattgttagtaataataatgctacaaaaacgttgtatacttgcaagatttacaaattacataatttatgatgattgaatgggggtggctctcttatctggatttcattaagatactcaggattctttacaaacatgctaggtttccacttagagcaagatctcttaaaaaaaaccctgcttattgaccacagcagccagacccgggcctccttctgcctactgtcgccataactctagttataacttgcttttgggtttatacctaggagtggaattgctggctcaaatgataattctatgttcaactctttgagaaaccacccaactgtcccctaggagtggaattgctggctcatatgataattctatattcaactctttgagaagtcacccaactgtcttctacagcagctgaaccactttaattcccagcagagcattggcagtccttgaaatgctcttccgtttgctgtttaagacaccatactgtccttgttctcccactctttctgtatagaaacccatatattttcttcctctagttcttcttcttattcctcctgccattggaagtgcctgtccatttcctgtcttgattttcctttgctgttttctaccatcctcaacaattttatccaacctagcagctttaaagatctcttcttcagcatgtctccaaatttatagcttcatttctgacctcaggtccatcgtgtctacagcgcatctccacccgtacatttcacttgcctctcggggttaactgtgtgtttctgaacgctcatactggggttaactgtgtgagtctgaacacctgtacctcattacctcattacttccttacctcatcttcctaagtgcacggtttcttgcagtgccatcctcgtcttcccatgcacctgaacccaccaccttgtatttgtctttagttcctcaccacctgggaggtcagtggtacttcttatcctttctctctctcccatgtggtttctacctgcaaactcttcattacagtggtcacaactggtttgaacatcatttcctcttatccagccaagacagggccactttcttttaagtttatctttctcccttttcctgtgatccaatctgcgtgcctgttactatctaattgacttcccaaagaataactgtgatcatatcatgccctcttcaaaggctgtcagtcttcccatgcttactgagccacaacgaaatgagtcccaacctgctttgtcactttcagccctcacaattccctgtcattcatgtgattctcctaccaaagtaagctgcttatcttctatgttcactgaaaatggtatgtttccttccacatctatctctaagggatggcataagtgggttgcaataggtttacaggaatgaggatcagattaagagctgtggcatcagtaaaaccaataactcttgatttattatgtaacaatgtatatttttagccaaacaaatgctagataccaataggtaaacctggtactaggaatttcttttcatttttgctttctttgagatctgtaattaatcatggtgaaaataatgctacagaaacatcatatacttacaagatttgcaaattccataatttacaatgattgcatgtgggtggctctgttatctggatttcattaagacactccggattcttcacaaacatgccaagttcccacttagagcaagatctcttaagtaaacctctgcttatggaccacagcagccagatctgaacctcctgctaccatccctgtaactctagttatgacttgtattatccatcacattatttgttgtcttatgaaggatgaagtgttcaaatccctgtaggaaacagaccgaaaactttgagtctgttacccctaagagacacagccctcttttctgaggcgtctttctttccttgatttatttggactatggtttctttggccaaccatttaattttttttttgttgttaactttgtccttgttaacattaattctctcatgtcatgtggaaatgagaataattcagatattgtaagagaaggaaaatggttagataaattagaagcatgaataattgatagagaaataattcaagcagctaactatatcatgcattctctgcttacttcatgaatgatccgtatgccatgtccatacgacttaatatttatttttagaaacctttaccaaaatgagcaagaagtagtaaatgcctcattatcctttcagagcacctaatgatacattattttctgttataaaacttcaaggtttttgaatgcattgttataaatccagactgtcaacatttctttggcaagaagcagcacaccatcctatagaaataagatgtaagattaacaattcaggttcatatattttcatctgtccctgaattccaccatacatggcagaaaaccacaatcatgttttcatagcaaatatgttatgacaaactatacaacatttaagaacatttagaaaagccaaaatggaactttcagaaataaaaccttggctgttgtggtggctcacgcctgtaatcccaacagtttgggaggccaaggcgggcagatcacctggggtcacgagttgaagaccagccaggccaacatggcgaaaccctgtctctactaaaaatacaaaaattagccaggcatggtggtgcgcgcctttaatcccagctactcgggaggctgaggcagaattgcttgaacccagaagacagagactgcagtgagccaagatcgcaccattgcactccagcctgggtgacagggcgagactttatctcaaaaaaaaaaaaaaaaaaaaaaaaaaaagaaagaaattaaaccttaaatagcaaaatagaaaagacagatcatcagcaatgattaataaaaaagctattttataaagcggtgattgggaaagtaaaataggttgtacagattgggccaaagcctaaagatattctggtgattctttccacgatagaagaccgtgaaagaggcaatgcagtgagaccataagccttgtggtttgggacacattcttttcgaaggcctaactttttctgttggtgaaatgggaataaaaatagtacgaatttccaggagttaaattagagttgaatgagataattcatgtgaggctcttagaaagatgcctggaacatagtaagaattaaataatatcatctaataaagtgagaatgaccacagaatatgtctttatatggtattcattgttaaaatgcctagggatggagagttctggctttagctgtaacttaatataggagttaaaaaggtatcataaccttaatattaggtctcgggaggtgtcactaggactctgttatcctttcttcccttctttcttttttggctttctatatgtcttcattttcagacaacctctctcctggggtatcagaagacacactcacattaggataatgcagataagatcaattcacagtaagaagatttatcaaggtaaagtgaagtataggagaagcacatgagaacccaggagcataaattgataaacacaccaattgaaaacagattggctgaattttaaagcaatagatatatgtttcttaaattagatagaccttgaatggaagggtacagaaaaatagaaaatgaaaaaaagtaagaaaatatatcctgtaaatattaaccaagagaaagttgatagagctatgctattatcagaggaaatagactttaaggagagaagtatcgctacagataaagaacgctatatcatatttatagaactatacagcaggcagatataataattccaaattaggatgcatccagtaacatatacagcagccccccttatctatgggaaacacatttcgagaccccgaccgggtacctgaaacctctgatagtagcaaagtctgtgtatgtatatagtcacgtgtgacataacaacgttttggtcaatgacggaccacatatgtgatggtgatctcataaaattataataccatatttttactgtactttttgtgtttagatatgtttaaatacacaaataccattgtgttacaactgcatacagtattcagcacagtaacatactgtacgggtttatagcctaggaacaataggctataccgtatttcctaggtgtgtagtaagctataccatctaggtttatataagtgcactgtgtattgtttgcacaatgccagaatcaactaacaatgcatttctcagaacatatccttgttaagtaacgcatgactatagtatgcttttcctatacatatgcaaatatgacaaagtttaatttataaattggacacaatcagagattaaaaacaataacgaatagtaaaatagaacaattacagtaatatgccagcatcactaatcttgaactttggggccattaagtaaaataaagcttacttgcatacaagcactgatatctcagcagttgacataactacacagctactgagtaactaatgggatagtatgtacagtgtggatacaccggacaaagccatgattcatgtccagaacaggacagcaggatatttagtcacactactcagaatggctcagaatttaaaacttacaaattatttctttctgaagttttccatgtaatattttcagactgcaattgactataggtaactaaaactacagaaagcaaaactacagataagagggtgactggtgtataaaataaaactaatatatataatagaagtagtcaaaatagaaaaacccatcatcatagctgaaaactttaacacatttctacatagctgatataacaagtagtctaaatataaaaaagagtaataaaaatttcactaaaatctgtaatatagattttactaaacaaaatttggttctaacaaaatttacaaaaactaagggtatgcattctgcagtgttcacgtggaatacttatcaatatattgtaggctggtcatagagtacatccaaacaagtttcaaaagatagaaatcatacagattgtatattctgaccattttaaatttaaaacagaaattaataacaaaaaaactaaaggatccccacatatttagaaactatgcaatatatgttgaaatattccatgggtaaaataagaaataatagtaagaagtagaaaatagtttgaatggaatataatggaaatacaacataacaaaacttgagaatccagataaagtagaggaaagatttacaaccttgaatgcatatataaatcagagaacaccaaatttaactctaataaaatggagggaaggaaataacaaaaatacaatttataacatagaaagtagacatgcaagaggataagtcaataaagtttgttctttgaaagttctgtaacttgatatcaatagtccctagtaagggtaattaagaaaaaaaaaagaaaagacactatggctaattaaacaaatggagacagcactagagatctttcaagaataagaaaaaagaagaaggcattgttaatacatttataaaaattaatttgaaaattaaaactggcaaattctgtaaaataaataaaaaatcagtgtaccaaagcataccaaaaaaaaagaaatataaaatctggtaagttctacatttattaaatgaaaactctgtagcctaagataattccaagtccagatggcttcatggtaaattccaccaaacttttaaagaagaaaatacactaatcttatgcaaactcttctgtaaaatagaaaaaaaatgaaacgctttccagcttctttctgaaggccaacataatcttctttgcaataactgacataaacattgaaagaaggaaaaattataagccagtctctctaatgaatgtatatgagaaggtagataaatttgacttcaataaaagtaaaaacctgtgctcatcaaaatacatcattgagaaagtgaaaaggcaggctatacagtggaaaaaaaatctttgtaatatatgggtctattacaggacatttatctaggacatgttaacaactcctacaaaaatataacaaaagggcagagaacccaactaacaatggaggaaatatttaacaggcttttaacaaaagaggatatctacatgaccactaaacatattaaaaggtttttagcatcactagtcatcaaggaaatgcaaaggaaaactacacggaaattattcagatactattatacacacatgtgaaaattaattagaatttaaaaagtaagtataataacaatagcaaggacgtgtggcaatcagaattctcacacactgtaaagctgaacattcttgacctagaaatcctacttccagatctataactaaaacaaatgtatacacatgtacactaaaggctcttacaagaaagtccagaataacactttgtaatagctaaaaactggaaacaactcaaaagtccatcaagggacaaatggataaattttggcacatatatcatatgtatataccaaatacatagcaaaaaaaaaagcaactgttattatgctcaaaaatatggataaacttaataggcataacattgcatgaaagaagccagatagggaagggaatatcctatggaaatgaagttcaacagcaggcagaactaactaatctctgttgagctatagatggtgatgtgaactaatctatattgagccaggatggtggtgatatggtttggccgtgtcaccatccaagtctcatcttgaagtgcagctcccataatccccacatgtcacgggagggatccagtggcaggtaattgaatcacgggggtgggtttttcccatgctgttctcgtgatagtgaataagtctcacgagatttgatggttttatagaagagagttccctacacacgctctcttgcctgctgccgtgtaggatgtgcctttgctcatccttcaccttctgccatgattgtgagtcctccccggctatgtggaactgtgagtccattaaaccttttttactcttttttgtttgtttgtttgttttttgagatggagtctcactctgtcgccagtctggagtgcagtggtgcattctcagctcactgcaacctctgactccctggttcaagtgattctcctgcctcagcctcctaagtagctgggattacaggcacgtgccaccacacccagctaatttttatatttttaggagaaatggggtttcaccatgttggccaggatggtcttgatctcctgacctcgtgatccacctgcctgggcctcccaaagtactggcattacaggtgtaagccactgcaccccagtctcaggtatgtctttattagcaacctgagaacagactaatacttgtggttacctttgaaaaggtgatgactggaaggggcctgagggaggtttctgagatcatgacagagttgtatgtcttcatctttatggtggtgacataggtgtgttcactcaaaaaaaattcaccaaactgtacacttacacttttgcagtttaatatatgaatgatacatgttatgctttaattagaaagttaaaagtaagtttttttcaaaagtagtaattggatgactcccgcttttattgagttagcaagtatcttttactgccactttctattgttaaaaaaaaaaaaaggctcaccactgaggctgtaaggctaaatccttagcatgacacacaaaaccatctataaaccagtttctagcctttcttcctggccattccctttgacctgagctgtcttgaatattcttaagacttgacaatactaattttaaaccgtctaagataagatcacctcccactccagaaaaggggtgagggtagatgttaagaccagagtgtgcttccagcacacttgtattttttatggtactaagaaagaaaaatgctgacgcttaaacctgcacacagtaattccttaacatcaatggtaaggttcctccctaattttgaaggcattaaaatggggtcggggaaatgtcttacaaatgatattttttaaaaaaataaaataaaacaaagataatcatgtcttggattatcatgactcacagcaactttactttcaaaagtaagaatatttacttctaaaactatgaaatcttcactatattcttaaaaatataaatcgttaaatgtcattctttagctctaaatacaaagttagtttgttgaacttcatgagttacgtcttttatcgggcttggggtgtgaccttagcccctctcctttgtgaggggagatggcagaactctcagaagctttttctattctcatctttgttggttactggggaaaaactggatttcgctgcactcatcaaataaagaggcccaggtagcagcgcctccacgttttgttcaagtggggttttctgcgtgtgccgctggccaattcttcaagaaaagtgtttgttcttctctggcggtttggtgttcctatgtttcaacatgggggtaccaaataattcatttccccttttcccaacagatgcattcttgtgacctcactgatgacaggggcgtcgtttattctaacaaatgctcttgtccaaattccaaccatgttgccaagagatggcatagctggtgagggctggactttaggggccaatctccactcctgagctcccctgaccacacaggaagaaaacattaatgatgttcccatactgatgttgtggtgtaagtgtctcctgtgtaaatagaactaaatatttaggaaagaaaacagaagagtcttatgtagtgcattacaaactagaaagcttttgaagtcagcatctgggatggtcttaaaaacaaacgtgcagtctgagagaaagaattactgctgacacacgctgacctcacagaaactatctggtgatgagattatctctcttccaggactctaacaaggctttgcaaggatattttcttgctttgctttgctttttttaatcttcttaactggtggaacctcttgttatgtgcaaatctaatccattctcattcaaagatggatgtcccggttttactgtatctgccttagttggagattcccgggaagaaaagcccaggacaagtggtcaggtgcaggaacttgatctgagaggtggtcccaggaagcagaagtgagttcatggggacattgagaagaggaaggaggccaatcaaaaaagagcatttctgaggttgcttctgtacacaggggcttcatttcttcaattctcccagatcctctgggaaccctatgaaatgcttttcagaattctcagagtcatccacctgaaaaatagagggactggagccttttttcctagtctccctactgtccatggattgagagttgcctgggagcagggagagcgggtgttaactgccttctgtttagaacaagttcctgtatgtgtcagagatctggggcaggatgatttgcagtcatgtaagcttaggttgaactctgggagagccaggtgagtgtgtgctcaaaaagaactgtccagtgcagctgctgctgaaatcagaggtgactgcaaggatgtaacactggcgctcgggtgtctgccatggcctaggtttcttatgagagattgaactcttcggagattccatcattcagagcaggcacaagacggtttggccaccaatctgggtagagccaggctgttgcatgacaagtcagtcaggagaaaactgaggctagcaggctgactttctggttccatgacacacatcacatctgcaatagagcttaaagacagggtgcttatccctcaaacctccctgtatcactaactttcttaatccagacttttgcctttgtttttttttttgtttgttttttttttttttttttttagaaggagtctcgctctgtcacccaggctggagtgcagtggcaggatcttggctcactgcaaactccacctcctggttctcgccattctcctgcctcagcctcccgagtagctgggactacaggtgcccgccagcacacccagctaatatttttgtatttagagtagagacggggtttcaccgtgttagccagggtggtcttgatctcctgaccttgtgatccgcaagcctcggcctcccaaattgctgggattacaaacgtgagccaccgcacccggcctacttttacgtctcataacccaaaagctctatggcttcaaaaattcccaactcctcaaaaagctgattttctgttttatcagtgcccctttgattgataaacaatatattaatataagatggatataaagcagatgtattttgttgccacaacttctttggttcaaattaaagaatataggtcatttgtcccagagagtcagtccagctgaaaaattgtggatgttgataaatgcgtaggtctccattcttaaaaatccagcatttttgtataggaacaaaactttacttggattataaattgcaggccttctttgaaaagacaaagtgtgaaagggaagagaactgtagagtcttcctgatgtttactgagcccttactccaaaccaggacttaggcttgttgcatcccctccattaactcatgtcatattgcctaattcataaagaggcccagagaggcagtcgaggtgtagaaaggttaagtaacattcccactgcctcataacttgtaagtaatgaaactctccggaaaagttgagctcagatctgaatccagagcctgcatgcctaaccgcagtgcaatgctatcctcacctcactgtgcaaatacatctcagatctctgcattaggatgcacaggtttacattttttaaaagcaggtaataactgtcttattctgtacctattgtctgttttcacagtctgctgtgaacccttgctttcagctgggacactgttgccttccactgccttccacagcctctttacttccccttaaacaacctattccaactggtactacttgataatagtcattttctctcacctgaaagcatgcctctgtcaaccaggctcttcccctcaatggctaatgactctcactcctacactcctgcagagggcctggcacatagtgggtgcttaatacaagttccttggcacaaagaatataggaataaatacggggactaaggtattgcgctctccattttacaaaggagaaatctagccttggtctctctgataccacagtctttcccaaagttgcacagcacagtggaggagagttggacctagggcccaggtttccaggatcctggtctagtgtaatgtcagtttctaattatgtggtccacacacatgaatatttaaatcagcatctcctggagataactcaagaggtgactctaatggtagacaattgaggctgtacatcagggttgcaaaggggctttgtccggatgagtggattttttgtgtcccttacaccatgtgaattcccagcatcatggtttatgctaatcctctttccaaaatagtttcctggtgaccttctccctgtgccaaccccggaatacaatgggatgagtaactggcaggtccagatacagaaaatgagtgagcaatgcctttcccagctaaaaattcttccagctcacccatggtgtgctagggaagatgttctcctatgtcctgaatgaccagcagcagaggattcagggcacccaatgcaaaattgtcaccaaatgactgtgacactgaagtggctcatgctgctctttgcactgcattaagtgaaaccagacgcctccagttaaactccagtgagctaaaaagtatagtgataaatatatgaaatgagtagaaagaacaaaaataaagaagcctcaccccagatacggcacttatgaagaatctgtgtctcagtctcccagcaaaattgaaacgtaattcaacttcagatggtcaatgcctgccttaatgccccatgctaatgtcagccctgagatgtcacaatagtccaggagatgcttacctgaaggagaggccctctagagaggctgtgagaactgtgatttggagctcgaaactgagatagtgagctgggcagggtgacaatttatggagaatgggaaaaggaagagggaagtattttagcaaaacggatgctatcaggatggctgaggctttagaaccagatggagtgctgtggcctctcttggatggatgctgtttctgagctttgcatctggaaagacagagcctgctctaggaataatgatgtcaaagatctttctcattttactgtctggttaaatatcacctcttcagagaagccttcccttatcaacttacttaaattgagtaccccctgtcagttttctatcacagtacctcacttgtgtgtgttttccattcatagcatttgttacactttcacatttttaaaagcgttgtttctttttttgttttttgtccatctccagttcctatcagtgccctaccatgtccttaacatttagcttagtgcctgacacgtagtgcttcagtaagaagtatcaatgtggtaagtgaatttctaatcgaatagcagttacatcataaatagtcaatgattcttgtgatgtctcatggtcccagggatcatgagatacagagtgacagaggatggaagttcagttttcttctctatgtaacaggaagcaaggaagtgatcgtcagaataactgcaagatgaccctgctggctgctgtgtgacaggggattagaacagtcataaaagcaggtagagaggtgtttcagttagctatggctgtgtaacaaactactccaaacttagagacttgaaataatcattctatgtggtcatgtttctgtgggtcaagaattccagcaggattcagctggttgtcaactgggtctttcacatagcttttttcacctggtaacttagctaggctggaaaatccaagaaagcttcactcatacacctggcaccttggtgattctttgcatgcaccttggtgattctatgtgctgttttgtctccctcatagctaatcagatgtcttatgtggtggttggcattttttttttttttttttgagtcagagtattgctctattacccaggctggagttcagggtgcgatctcggctcactgcaacctctgacttccaggttcaagtgagtctcctgcatcagcctccctaatagctgagactacaggcacgtgccagcacgtctggctaatttttgtatttttagtagagacagggtttcaccatgttggccaggctggccttgaactcttgaactcaggtgatccacccacctcagcctcccaaagtgctggaattacaggtgtgagctatcacgcccagcctggtggttggcttttaaagggagcaggtcaaccatatgaaaacagaagctatggctctcttgaggcccagccccagaagttacacaccatcagttcccctgtgttctgttcgtcaaagcagcccaagattatctcaaaatcaagaggaagggaaatagattcagctcttcatgaagattggcaaggaatgtgcagccattttcaaaccaccccgcagagagaatggttaggacattgttatgataaacccagcctaaggttatagcaatagagatggacagagatgatttagctgaagatatagctgtagttagcatgaccagacttgccaatggttgtaatagggtgtctggattagggagatgttgtttatctctactagtttcctgttaattactctatgaacaaattagcacaaactttgtggcttaaaacaacacaaatttattctgttttagttttggaggccaaaagttcaaaatgagtttcacaaggccaaaatcaaggtgtcagcagaactggttccttctggaggctccaaggagcatttgttccttgtctcttcagtctctggaggcagtcgtgaccccttcttacaacttcaaaggcaattgtgtaacatttttgcagggagagtcctgggaacagtgagacaagttggggagaggcaagtggaagggacagaatcaagattgaagcaggctaagtatgaaaaatttgtaagatgtccaagcggagatgccagaaaaagtcagatgagtgtatgagtctcacatttcagagctaaaaatatacactctggatttatcaatataaagttagatgagggccaggtgcggtggctcatgcctgtaatcccagcactttgggaggccgaggtgggcagaccatgaggtcaggagctcaagaacagtctggcccacatgatgaaaccccatctgtatcaaaaatacaaaaattagctgggtgtggtggcatgcacctgtgatcccagctattcaagaggctgagataggaaaatcgcttgaacccgggaggtggaggtcgcagtgagctgagatggtgccattgcactccagcctgggtgacaaagtgagactgtctcaaaaaaaagaaagttatatgagtattgttgaagtcatttaggaacagattttttagcaacatcatccagtagaaatgtaatgtgagccagaaatgtaaatgtaaatgttctgctagccatatttaaaaagtaaaaagaaaaaggaaaattaatattagcaatatcttctttaacctgattattatataatgatcattccatcatttaagcaacataaaaagcaatgagatattttagataactttttccatactaagttttagaaatccagtatgttagctcactttccaattcagactagccaatttctttttgatggagaaaatgtatttaattaaaagaattattcttactattatttttgattggcaagtcataattgtatgcatttatgaggtacaatattatgttttgatacatgtataaaatggtataattaaatcaagctaattaacatgtccatcacctcagttacctatcctttttttgctgagacatttgaaattgactctcttagttattttgaaatatataatacattattattgactgtagtcatcatgctgtgcaatagtctcaaaacctctttctcttgtctatctgaaactttgcactcttagctaaaaaaaatctccccagtccctcccctgcacccccagccccaggtaatcaccatcctactgcttctaggagtttagctttatttgatttcccatacaagtgagatcatgtggtatttgtcttctgtgccttagccatatttgtattatccactggccacctttgtctcctggtgatatactggacagcacagctttagaaagaagagattctagaagttatccctgaggaatcccagcatttaatggtcggatatagaaaaagcttgaaggtagaagaaaaaccaggacagtgtagtattgcacaggtaggaaaagccttaagaagtgagttgatcagctatgttgaatgctggtacaaagatgggtaagatgggatggagaagtttctacaaaactgctgctaattcaaagaaacagatatagaccacttccaggctgggcgtggtggctcgtgcctgtaatcccaacactttggaaggccaaggtggacagatcacttgagatcaggagttcaaaaccagcctggccaacatgctgaaaccccgtctctactaaaaatatgaaaattagccaggtgtggtggtgcacgcctgtaattccagctagtcgggaggctaaggcaagagaatcagttaagcccagggggcagaggttgcagtgagccaagatcgtgccactgcattctagcctgggtgacagaacgagatttgtctcaaaaaaaaacaaaaaaacaaaaaaacaaaaaaaaaaaaacaagactacttttaggttctcgctctttggatgtgttgctgtttcctgcactctcttcctactgtctttgggtggtagatggaagggtgccacaggacacacagctggggaaacttcctcttgcaaagcctctactaaaccatgccacaccactgtataataactggaaaatggctttgggacttaaaagcaacttcatccaagaagaattgcagtttggatgcagtccaggtataaaacaaccaccttcactcctgtgtgttactgtaaagcttgccttctgtaaaatgtcttaagcataagagctgtaaaggaaaatactcatggattatattgtgatttgaaatcaggatgtaatacgatagtgacagcttaaagattcttctaaaactagatatgaaatttgaatgtggcacctgtctataatttgtaaagcactttggctttttctcagctacatggtgatgatgagttcttctcaacaagtgactaagctctaggggaatcagtttctcaatttgcatgagatacgggagcttcctaagacatgagactttcagttttaaaaccaggatagtcttgagagagctgcccttgtttttcggagacatgcaggcttcccaagatgtgagactttcagtgctaatcccaggaaaagtcctaaacaaaaggcaacgagttggttgcccaaccaagctgggaggccttctgaccgaggacctcctgaagtcatcaacccaaagagaagaactgcctcttagggctgactgatgcttacaaaagggattataaagcctgaataccaatttcttaatttgcaaagagaaatgatgtgacaaggaccaggaaactcaaagtccatatggtcagcattttctgtctctgtataaagccaatctattaatttaaagaacagaatgattatcacatgcattgaaatacacaaagtccaaacgatcagcaaattctcgcccggtgtgaagtcagtcttttaatttacaaagaaaaattactgtcacagagactggaatgctcaaagtccacatggtcagcacattttctgcttctactctacccttcatggaagaccaattcataatcagaaggctgcttagtgagcatgaagtgttggttagagtgagtgcttaaaggcactggactaagaaagcctaactttaccaaggggttcagactgtctttgtcaccaaatgctgaagtctttgcttcagcaatttttcctgcctctaggatgagtactgcaaagttgcctccaggaggcatcttattttccaagctgccatggatgactgaccgttttaagcgtccttcattcttcagatgtgctaataccatcaattaggtagtagagtttcacttccctaggagccattttgtctttgctacatttatctttgctcttattccaaagagcagccttcattctcttcctatcaaatctttcagcagcagaaggcaactgactgtatctctgagtaatgttgataagtattgtgttgtggaggctctgcatagtacagtggttaacggcacgggctgagaactgaggaatacctactgtctacttgtctactaccatgcagaactatagtaagtcactatatccctttgagccatagtttccagttctataaaatgggaaccatccatagttggttgtatcaaggactcaatgacagcaaacaagtaaaagaacccatatagtgtttgagacatgattgtgctcaagaaatgataggaaacaaacgtacaaacgacaagcattttttgctgcagtttggaagtattaatgttttacaacctccacaaactaaggttcatgatcgaagaacctcactgaatatttaactttagggataaaatgcacaacctataataattttagtgcaattgatttattatagtcaagggaaacatgactgaataacaaaagtaggttaggaaaatactgaaacagaataggatgaagaaaagcattttaatgaaaaaggaaaagcagagagcagagtagtaatctctcttggttcctctccttccgtcagcctgctgttcctgcccctctcttcttctctctggcctctagataccggaatgtctcaggcctcccatcccctctatcctccatttcgccacctgctctggccaaaaagtttgaaggaggacctatgaaaaatatccctggcctgggcttaagaagccttcaccctcattctcaactctgaggctaccagagcatgatcagttcatcatctcagtcaatcctcccagctcctctattagatccatatgactgccactttgtgaaagatacaaggaggacttggcaaaacaagggccccacctgaaatggatagctgagagcattaccacagtcggatctgctgggttgaattgtacacagcagatgccaacttccaatgaaattagaatcatatttctatacattttcttaagtgccagacatcattctaatcattttataggcattatctcacttagtgtctaaaaaaccctaaggttttgccatataactttcatccccactttattatctatctagaataactgaggcttatggaggaaaactgactgactcattgctgcttggctattaagtggaacttcccaagactctgtaactttggagactagtcacatatgaaatatgctaccctctcacttgtgtgatgacgttcagggtttggcgaatgttgagcaagccaataaggtaaggctgtatgcggtacaattctcacactcgttgctctttttgttgtaaccagcctctttaaacactatggcctgaccctctgaaccagccacctgaccattcttctgacttcccaataagcctttgccatcaccaaacatactggcctccatggtcttcatctttaatgccattaattaaaaaaatatgccccacagctctgcaagaagaattcagcaggcagttggcataaaaaggttgggaatggtttacatctttgagcttcagtattttaagtctgcaagttcatggagtgcaagggctgtggacaccctgcttgccaatttttctgccttaaccgttccctgcccccttgttgttcaatttctggccaatgtctaaattttccaaaaggaagtatggtcttttgcattatgacacatgattgccacccactggttaagaatgttttcactatgaaggtttagaaggtttgctgttgaggcaaaagttacccatttcccatgcccccagttcagttgtctggatatcccagaacaagaagcattaactgcttcaatttaagtcagattctcaaaatcccaaaggcatgtctttcacttatcccataaaacatctaattaaattatttcatttaattgtacatcttgaattatttgtttgcatcttgaattatttttgtcaatgcgcattttccaataaaggagtaatcagtggtctcaatgtcattcagatgaggccacccttatttatcagagttctaacaccaatcagtattcatccacagggctctttagtggaactgtggcactctttagtggaaatgtgagtttcagatttctgattaataaaaataatttgtaaatatgatcacataatttttgcaataccgttttcttttctaagaatcacctatagaaacacctactacgtgccaggcattgttttatgtgaacatttcatgtatgtaacagccccccctaaggtagaaattgttattgtcattcttattttgaagatgaaaagctgaggcatgaagagggtaagtcaccatccaaagtcacctatctaaaaaatgcaaagccaagattcaaactcaggaaatgtgttactagaatcttatctactatgccatgctgcctctcagaaagactatcactgcttcctccagcctcatcctcttgtcttttcctgggctggggccatcctcaccctgattggctctccccaaaggctcactctgacacccattccagtgctaaccctgttcagagtggacaggaactggtccatgcatctccttagatttaacacgataggctctgtctctcacaagggcaggcagcaagcaattgtcttttagaggaaaacaaaccatttgaactaaatgttgattcttgctctctctagaaatgcagacagaaatcggcaatcagtgtagttgatggataccagaaaaagaaataaaagtaaggaaatgaagaaaaattgggccaatggcactttaaaaatttcccaaaattttgaggacaacttccctttttttcaaggcacttgatgcttctctagatagaaaaattgttttcacctaaaatatcacactagctgttctgaaatcctcttgcttcttggcatgcttattaagaaattctgctcttgcagcaacaaatctcagctttctttgcttctagagaactttaaaatcattaactatcctttaaaaactcactcttggaaatacatgtggtctctttccctataactaaatatttgatacaagccactatcaacttgatactgacagtttaagggtgttgggtacgatgacctttgaggtgccttctggccataagtaccaaggaattcataaagttggattaaatgataacaaaaattggaactttccctttatcttcttttcttcttaaagaataagttaagatacattgatttcatttcacaacttgcacggaaatgagtgttttactgttgatgtttttatgatctgtagtttccattctttttaatagccttggtgcagtattaaaaaaactatcttggtgataaaagttattttagaagtaaaagttgctttagaaaagcaaacatgactaatataatccaagttttctcaggaaggaaagcgctagtgtgactggacaatgctgagacgcccaagaagatgattgaccttcaattacattgaagggaatgactgaactatttatctgtgagggattgtaaatcaggagccaagggaaagccttggaaattcaaatgtaaaaacctagttcagcaaaggagttgtcttaagcaatagtatataaatcaggcagggttaggttatactacagtaataaacagcccccccccccccaaatatcaatgacctaaacaacaggagtttatttattgctcatgatatacaaccaatttaagttaggaggggagttatgcttcacgcagtcatgccacatgaggtcatgatagcaccgtcttaacatgatgcacctgagttctcctggcaaaggaaaagaacattccagattctgcattcacaactgaaggctctcctaggcatgagacaccatgcctcttactgtgatttattgatcataataatgtatagcctcatttaattgcaaagggatcaggaaagtgtcattctgaacattctcagaaaagcagagacctgattatacatgagtgttagaagcctctacaacacagcaattgtggactgaatgcttcattcaggcaataagcaaaagcctccttcagcagcgtattatttaatcctcacataaccctgcaaggtgtgggctttcatgatccccctttctcggataaggagactgggaatcaaggaggttaaatagtctgcccagagatgctccccttcctattaagagcccagttgtaaacctgtgctcctgactaccatgtagctcttccctgagagctcctccaagccttggttaaagggccagaccctttgctctctgagcaggaggagagcaacgtctgccctcactgacccattaatagacacctgtcagtgaggaagggaggcttgttcacttcagggagctgtggtcgcttcccctgtgccactggaaaactaataattcatgaagttggctttcaggtacgagcaagctggactgaatagttgtttcaagtcataaacatagaaaagtaagttgataggagaagactatgtggagaaaatttaaccatgttaaatatttgaataaacatttaaaaatacatagcatatataggtgcatatataataaatttgagacagtaggcatgacagagttctgaaatagtttataagtatgtgagttgtaaatatcccatttatattatgcatagattataagtaaaatacacagaattgattctatgctccatcatctatgtggtcatctaatcatccatctctctaaactaacgtcaaagagacatataatttaaagcacatatgcaattctaaattttcttggataagcttttaaaaactaaaaataaatatataaaattaatttaatagtatattttatttaacccagtgcatgcaaatatgattatttcaacatttagtcaagtcgaaaattgttccatctttttggtacttagtttctgaaattgtgcatgtattttacccttaaagctaatctcaatttgggtgctaaaccttcagtggaaatccttgctctgtattcagtttataaaagatgcggttaaagaaaccaaactcacttgtccaaggtgttccaaagatacttcaaagtttgcaatcgtttagttaatctgttgacaatggttagattgctgttgtgtttatatataatgctagaaataatgcatatgttgggcatgtacattacaatatgatcctgtcttccagaccataaacacaattagtttttcctggaggattctaactcaccattgggtacctcttatatggaaaatcattagaaatgcctgtcctctctgcaaccagctgggaagaattttctgtcaaaagctagagatgtttgtgtgtttttgtcaatgggatcacaaacttgaagtcagaacagttggattctggatatgagtcttcttttaccagctgtgtgatcttaggtgttctgggtcccatttgggaaatgaggggtttaattgcctccaagcttgatctgtgcatggagcaatgtcgttatgagaattccccacattttgctcccttttggacctccctaaaattcccctaagaacacccctcactagtagaaatgtagaatcccagaccttaccccagatctactgaatcagagtctgtatttttaacaagatcccctacattggaggaaagttgtagaaagactgccctggaggatttctaacatttctgtgggctctcatattccttttaaatatacattagaatgaaatgcagatattttaagatgatgtggcctttcagagagtagttgcatttactaggatgtgaaagaaacacttttcaaatggtaacgatgtgaaggtgtcctaagtgcttgtgttgagtccagcactgtgctggtagctcacgaactcctcgtgacaacctggaaccccatgaaccccattttacaggtaaggaagcacaacctgagagacatgaaattatccaggcaggcttgcgtggctagtgattgtgaagcttggatttgagtacaggtcgtctggttccagagcttgcacgaaatcactgtgctagtaagaaacagagttcgaggttgaacccgggtgactcagcatcaaggaatgggctctctctttggggtgtgtgtctgtgtgtgtgtgtgtgtgtgtgtgtgtgtgtgtgagagagagagagagagagagagctttcttaattaccacaccatactacctccattttatattaaacagaatattggaatcttgacctttttctgtatttaattagatgctgctgtttaataacctatcacaaaagttaggcaggcattcacacacatggcgatgagaattccccacattttgttccctgtgagccctccctaaaactctcctgagaatacaacagctgcatttaaagaagctgaatcccctattgcagattttattcctgtaaaaatatattgaacttgacgaaacagagaaaatgtggcctgcttagtcagttaccctgacactatagctcttcacaaaagttttaagatatgatcatatatttaatataatatacttagtataacatgatatatgtgctatactatagcatagtatgtatatgtaatatatataatatacagtacagcatagcaattgtctaccagtgacagatttatttttaagttttttattgacacataatatttttacatatttttaggatatatgtggtattttgttacatgtacagaatgtgtaatggtcaagtcagggaatttagaatatccatcatcacaatcatttatcatttctatgtgttgagaacatttctagtcctcccctctagctattttgagatgtacaatacattggtgtgagctgtagtcaccgtactttactattaacattaaaacttcttccttctgtctactgcctgtttgtacttaactaatttctcttcacttaccctcccagaccgacaaacatctgcatccttcccagcctctggtaaccaccattgcgctctttttctccatattttaggtcccatctgtgagtgagcatgtgcgatatttctctttctgtgtctggcatatttcatttgacataactatctccagttccattaaggttgcagcaaataatatgatttcgttcttttttatagccaaatagtatttcattgtgtaaatataccacaattttttaatccgttatccatttatccactgatgggcacaaggtccgttccatatctttgctatcgtagatagtgctacaataaacattagggtgcatgtatccctttgatagactgattttctttccttggtataaataccaagtagtgggattgctggatcatacggtagttctatttttagtgattttttaagaaatatccatactgttttccataatggctatactaatttacttttacaccaacagtgtatgagtttccttttctccacatccttgctagcatctgttattttttgcaatgactgatttctatgaacaggagtctttggagccttccttcatagccatcgtctcacacagtcctcactggtgctattaccagctccatttgcagaaaaggaagctaaagccaaagcttaagtgagttcctgataaatagtccatattttacctcaggtcttctgattccagacatcacgtggactgtctgaaagacgcaaaattagacaaacagcaaaaaagagaccctgttggtgtccaacacttataatgaggctcacttctgaggacacgtgcagcctaagcaaggcagccactgcctctcaccttacagcttgctgggctgataatggccataggggatcctcagccaatgaggggtaagatctgtagataaacatccttgggtccagcatccttgacccttaatggacaattctgggggatgtttctcactgtctcttagagagtccccagtaggattgagctccagttgcccacagtggaagtctttccatgaatgcaccctttattggcttgtgtccacaccctgtcttacttcccaactccctcacttgtgattcctggcataacctcccaaataaaagagtttcaccccagttcttgtctcaggggaccacaaagagagtgactatgtggccccgtgaagatgaacttgtgacaatggcatgaccaaggtttaccacctgagctctccctgttagcgctagttacatgtagcatgtgagctgggttcttctttcccagtcattttcctgtcttaaccttggggtgaaggacaatgttcttgacctagaatggcctaggcagagtctgataagattgttgtggatgcaaagggaacagggttgtggttgctgagcattgcatccagtgcgtaccttgttcccttgctgcactctcatcatgtttggattcagatgaactttgatgttctgtgtgaggtggacgttagcactgtatctgtactgagttaggcgaggcggtcccggcaaagtaattacaaggaaatgctgtattttagattgtttgagttttccaatagagacatatcaatcttgcttgggaatactttgacttgtgctttgtgatcagatttccctgtgcttctggtgaagcttatggattcatgagttagctctgcaaatggagagtttgtgttagaagtcaaatcagttaaagctctttgatactgcacatattcatgggcagaattgctgcaaaaatcctctaaacacatacgaggagctacattatacctttaagtggcaggatcagcttcgtgacaaaaaccaaaccaggaatgagaggggaaaataatctaaatgtgttaagggaagtatgcaaaatggctgaaagctgacaaatggcagagccagaacgtgagttctgctgattccagacatcctgcctgatgaacataaaattggaaggaaaaaaaagtaaatgagctatgatgagaccaagtggcccatatgggtatcaaactcaacaggatggcatgaccaggcttttttactcaggcacaaagagcttttgagcattgtttgataatattccaaaaagaaaatgatagagccaaatttcccaaatgttccatgtaaaactaggaaatgactgaagcattcaccctcatttctaagtattgtaagtgtctggatcagaatccattgccatggcttattcattcagagcttgttgctggggattgggatgcttagactggcaggactggtgtctccttggctagacaaagatccttgcatggcattaagggagcctgtcctgacatttcataaaatcatttctgaaccgtgacgtttccagtattttattgtgaacattttcaaacataaagttgaaagaattttacactaaaccaccatgtgcccataacctcgattctacagtttacatttgacatttccatatacttgctttatatatataaatatacacatcacacacacacacacacagtccctgcctctatacatccaccttactttttatgcatttcaaagtaagcaacagatatgtaacactccaccccctaaatagatctgcatgcatattgttaattagaattcaatatttgcttttggttattttcttcttcagaggaaaatttacatactatgaaacccacaaagcttatgcgtcatgtttacattttgacaaacatatattactttggtgcaaaagtaattgctgtttttgacattaaaagtaatggcaaaaaccgcaattacttttgtgccaactgaatacaactgtgcaacccaaacccccatcaagatagaaaccatcattatgacctcagaaagtttcttcatgaccttcctagaggccaccaatattctgatttttcccatcatagacttgtttcaagtttcattggttctagaattttatatgaatgaaatcgtatggtatatatatttttgtttgatttctttcactcagcataagattttctttttctttcttttcttttcttttttttcttttcttttttttttttttttttttttttgagacagagtctcactctgtcacctaggctggagaacagtgatgcagtcttggctcactggacctctgcttcctgagttcgagcgattcttgtgtctcagccttctgagtagttggaattacaggtgcacaccaccatgcctggctaatttattgtatttttactagatctatggttttgccatgttggccaggctggtctcgaactcctgacctcaagtgatctgcccactttggcctcccaaagtgctgggattacaggtgtgagccatcacacctggccagcataagattttttagattcattcatgctcatacatcagcattcatttctctttgttgctaggtaatattctgtcacctggtcacttgtatagaccatatttattatctactctcctattgatggatgtctgagttggttccagcttttgattacaatgaataaaattgctataaaaacgttcatgcacaattctgtgtatagacctgtttttctttcgcttgggtagactcctagcagtaaaagggtatgtcatggggtagactcatattgagtgttatcagaagtgttcacttatttttctgaattggtcgatcctcttccggataacgcgtgagagcagtgacggctttgcatcctcacaaacatttgctgttactgatctttttaattttagcgattctggtgagtgtgtagtggcatcccattgtggatttaatttgcgttaccctaactacccatatgtatgcttattgaccattctgttctgttctgttccttaaaggaacattttgttcgtttattggctttgtttgtttttggcttggctaaagtcaaacttgcatcctccatctgacctgagatgagagtcagctcaaatagggatacctggagactgctcacgcgtgcatggttcgggggtcaacatcggcagagttttgggcagaattcatacacagaagttggggcttcctgtcactgagtctcttctatctggattttcctcccttaatttccaacagctactgttgtcatgaactctgttctctgttctgtaaacaagcagtccccaaccttttggcaccagggactggtttcatggaaggcaatttttccacatattggggacggggatgatggtttgggggtgaaagtgttccagctcacataatcaggcgtttgttagattctcataaggaacgtgcgacctagatccctcgcatgtgaggatcacaattgggtttgtaggtttgtactttgtactcctataagagtctaatgccactgctgatctcacaagaggtggagctcaggcagtaatgctcacttgtcagaggcacatctcctgctgtccggccaggttcctaacaggccacagaccagtaccggtccatggccgaggagttggggacccctgctataagccaccaagactatgggttttcagtcagaatgtagtttcccatctggcactggttggtcctcttatcaggctgaaagccagaaaaatgggaaatttacccagtgtcaaattcttccaagtgtttagcctccagttttttgtttgtttgtttgttttggttttttggttttttttgagacagagtcttgctgttgtcagcccgggctggagtgcaatggcgagatcttggctcactgcaacctccgcctcccaggttccagcaattctcctgcctcagcctcccaagtagctgggattacacgtgtgcaccaccacagcaagctaatttttgtatatttagtagagacggggtttcaccatgttggccaggctggtcttgaactcctgacctcaggtgatctgcctacctcagcctacgaaagtgctgggattacaggtgtgagccattgtgcccggcccaggtttttcatgcattgaagttcacactccacattccccaggtagttgtttattatatgtggccaaaagtttatagcagttttctacaggagaattggtcaaacaggggctactcagctataccagaagtagtgtcttctgcactataaatttgaatggctttagaatattccattgtatgaacgaacacaccttcttttattaaccttgccttctatggatggttattcatattcttcttattgttctctgttatgataactttgcctctgacacaaaatcaacctcactgtgatgcatactggatgtggaactgaagcaagggacaatttatctgagctcaagcttgctcatctgtaaaatgggataattataataacagaaaatatgtgctttaatgagacttaaatggaaataatatttccaccaaatgcaagtagtaatttagtgaaacaatgtgtgcaaagtacctagcactctctggcatgtaattaactcaaattaggtgctacttggttctctttgtagttgtcattgttaccattatccttgctgcctacactcataaatgtataaataaaagattggagaacaaatggcatgtacgcaaatgtgtttcttcctttttataaataaacataccatgaggattttttatgtcagtcaagttgtttttgagaacatgattttaatgactgcataatatttatttggatgatccatggtgttggaaaataataagttacatatctaccttatataaatttctctggggaaacaagtcattaaaaacaagcttatttctaatttcagcctaatgctgatagacaatgtcaactggataaagttgagtcgcacatttcagtagctagaatgctttttaaaagtactttcacgtttggactaataaaaatgacatatctgtctcatcccttttcaaggaagctgaagtgcctcatcaaatttattttattaggatcccgacagcaatcttgtggcctgggtgaaggtcaaggaggttttgccttttgcagaagggagtaacaagtgatgtgatgataaagtgttctttctctctcggttcatccatggtgggaaagagcccttcagctcattcttcagttggaggtggttcagggccccatgttgctcaaattggtgatgacagccagctgtttggtcccaattcgctgagactaggaattcaaacccaggaaaattgagacacctgtgtatgaaaagcataaagagaaaatttggttgccctcatgctcactcttatgccaagtatttattcaagaattaaatgaataagaatagggatttcaactacgttctatcctcctcctcctcctgcatctgcctgaccttcttgggagccagatgttccactgaacactttgcatgcactgtgactatctaatgcaatccttgggacagatctgtgaaatagagtctgttattagtcccgttttaaagatgaggacactaagattcagatggtttaagtaacctgtccagtgtccacagctcctgtattagctgagagtcttgtgccattatatcagaaaagtctgcttgtgtcttacagtcttgatcagaaacaagtatatccctcagaacatagaggcggcaatggggggtgactttgttctaacccacaaggaagattattacatgaatagtatgggaatcttggcagaaaattagtgggttattttttagtccttattagtaaggactccaggcaagatagagttttgttttgtttttgtgtttttttttttttttttttttttttttgagacagagttttgctgttgttgcccaggcgggagtgcaatggtgcaatcttggctcaccgcaacctctgcctcccaggttcaaacgattcccctgcctcagcctcccgagtaactgggactacaggcatgcgccaccaggcccggctaattttttatttttagtacagacggggtttctccatgttggtcaggctggtctcgaactcccgacgtcaggtgatctgcccacctcagcctcccaaaatgctgggattataagcatgagccaccgcacctggcaagatagagtcttttaactttgaaaagttaggattcaaatcagtctagccattgaatcgtatttattgagcacctgctgtgtatcaacctcagtagaagacccaagagatatactggtgaatgggatagacatggtctatatttcagaggcctactagtatacagttgaagacgggcattgaacacaggatcacagctatgctaataggggtgttactgcagggccatccaacctagaacaaggatcatattaccagcgtttagagaatagggtatacacatgcttttaaatgcacagagtgtaccacttcagagaatactgatttctccttagtttgggctgctataacaataccagtgactgggtagtatagaaaacaaacatttatttctcccagttctggagaccagaagttacagatcaggtaccagcagggtagggtttttggggagacctgtcctcttggttcacagacagctgccttttcattgtaaactcacacagtaaagagagagagagagagagaaagagagagagagaaagagctcgcaaggatcatctccttagaatggtactaattccatcatcgggttccaccctcatgacctcatctaaacctaattacctttttttttttgagacagagtttggctcttgttgtccaggctggagtacagtggtgtgatctcggctcaccataacctccgcctcccaggttcaagcaatcctcctgcctcaggctcccaaattgctgggattacaggcatgcgccaccacgcccagctaattttctatttttagtagagacggggtttcttcatgttggtcaggctggtctcgaactcccaacctcaggtgatctgcccgcctcggcctcccaaagtgctgggattacaggcctgagccactgtgcccggccacctaattacttcttaatggcccaatctccaaatgttatcacattggggtttagggcttcaacatagtaatttggaggaggacacagaagttcagctcgtaacattccactctgccctctccccacacatttatgtctttctcacatgcaaaatgtattcattgcatctcaacagcccaaaaagtcttaactcgttccagcatcaattgtcaaacaagctagtacaggagttgaacattttccagattcagaaagatctccctgcccttaatcccagcattttggaaggctgaggcaggtggatcacttgaggtcaggagtttgagaccagcctggccaacatggtgaaaccctgtatctactaaaaataaaaataaaaaaaaaatagccaggtgtggtggtgggtacctgtaatccaaactatttggaaggctgaggcaggagaataggaggattgactgaacccgggaggcagaggttgcagtgagccaagaccatcgtgccactgcattccagcctgggcaacaagacaagactgtctcaacaacaacagaaaagaaataaaaacaccagaaagatctcactaaactggagcaatggactaaagcctcaaagaggaaatttcatttataaggttaggctgtagaagtaagtacagaatcaagagatttggcataagaaaaacctacgtggaaaagatcagaaaaagtccctcaagcacagagtcaatattaattagcaaagcattcggtgctgctgttttaacagcaacagtgaattcgcacgtttgtttttcaggccatgcaaagggaaaaatgatttatgtctattcccagacagtgtgttttaaacggtgtcttccctttcaagagacttttctagtaagaattttttttaatagggaaataagtaataactttgagagcaatttaacttgatcatgaatcagaatgattcagaaccacaaaagaagctgatattctttcatgttctctaaatatcttcactaaatgtaaagtaattggacatttataagaattcagactctcccataacaaaagtaataccaatcatgggttggtataggatgcacagttttaaatacagcatcttacttgattctcaaaatactcttgggagaagagcccaactggtgtttttatgtgtagtcactgtgtgtccacctgtttcagtaaagcattaggacaatttacataactctataccgtacagtataaacaaggctgtgatgaaatttgaaaggaagacaataaggataggagagctataaagaaggcaaaacaagtgaacacaattccaatctgtgtagtcctgcacatttgctggaggtggaacaaaatccttgcccccatgttatgcatatggaaattgagatttggagagattactgacatgcccagtatcacagagctagtgagtaacagagcccaaaacacatcagccccaccgaaattctgttgttttctctagtactctatgctgccttccaataacatgaaatatggaatttgtattggaaaagatgccaactcgcagagaaactcgatagaactatagttggaagtgtcttttcaatatgagcctctagctataaatggatgaaatttccactccctcaaagcttagaactttcttactcttagcagctcactagttgtttaacatacctaatattaaccatctggtcagggagctaaatacaatgaagggcatccagctattatcccacccatttgcctatcccaagttatgttttattaggttgagttgtcaattttaaataatcaagaaagatagctccaggtaagtctcactatctcgttaataaccctttaccaattgcagctgtttcgagaccagacctttgcaatgagtttagaaagctgctgtggacctatcataatttttactacactttgtggccacatgaactggcagaagaggctgtcctaaaatcctaatgtggcaaaaaccaattttcagaagtcaatttggatgttataggtagcgctcttcacacccaataaattgcttatctttggctttgaactgatgggcacgtacacaaaagattggagccaactgattgcattattagctgaggaaaaagtgtgtgactgtggcgaatttagcaaggggtagtctggagaaggatctgtgacctgggaaaagtttgttttgacgtggaaggtcaggagtttttgtttgtctcttgtgtccctttttacgttcatgtctgtccagaagtattcatcttctctttgtggtttaaatgccctgggcagctgaattactgtgtgacctcctattgtcagagcatctttgtggaggagaacccatcacctgtctctcgaaaacagttgtcctttgaactttcaagattatggggaaaaaatgtacttattttctcaatcatggagagcatgtcctttagagatacctttggctgcagatatgtgacacagctgatttaaaatagcttaagtacccaggtgcagtggctcatgcctgtaatcccaacacatccggaggctgaggtgggtggatcacctgaggttaggagtttgagaccggcctggccaacatggtgaaaccccgcctctactaaaaatataaaaattagccaggtgtggtggcagcacctgtaatcccagctactcaggaggctgaggcaggagaatcccttgaacccaggaggcagaggttgcagtgagccgagatcgcaccattgcactccagcctgggcaataagcacaaaacttcatctcaaaaaataaaataggttgagtaagtagaggtgtttttcttgcctaacgagaagtctcagtgtaggtgatgctgggtttggttcaactattcaacagtgctatgagaaattcaggctattcctctacttcatctcagcatccttaattgtctggctttaatcttcatagttttccccttatattggtctgttttcatgctgttgatagagacatagctgagactgggaagaaaaagaggtttaattggacttacagttccacatggctggggaggccctagaatcatgacagggggcaaaaggcacttctttcttggtggcggcaagggaacatgagaaagaagcaaaagcagaaacccctgataaacccatcagatgtcttgagatttattcactatcatgagaatagcacaggaaagaccagcccccaggattcaattacctcccctaggtccctcccacaacacgtgggaattctgggagatacagttcaagttgagatttgggtggggacacagtcaaaccatatcactcctcatggtgtgcaagatggctgatacatgtctagctatcatgtcagcaagactgggagaatgtggaaagggtgagccagccagccatgcttgtcctctttggaataagaaagtcttatcaaaaaccactagaagtctactgtttgtctctcataggccaggactgtgttatgacacagctatgcttagctgcaaaggaggctgacacagcaagcatttggctgttttatttgtgccttaaacaaaatacaagctctacagcaagaagaaggagagaaataaatgttagggagatgagcaaccatgtcactatgggttgtatagtcaaatacatatatttgggaaacgttattttcttgctgacagaacttctcagaggtctcaatatgctaagacacattgaagctcttgatggggaatagtcattatatttggcattttgccagagtaaacaaagaacccttaatttattctttagaatacctattaattcagaagtgttctgaatggcgtcatgaaatactatgttagtgccagctcacatcctttgctgagagagttaaacgtatttgtctcaaatcagcacagccttctacagctaaggcaggtgtactggctgctccaattgagaacaaacaaggcaccagggcctttgcatgtaccccatgatgaaaagatggtggcctaagtgcaaaatggttaatgaaataccaaactcagataccaggccactggtgtcttccagttcactacatgtttaaggcaaaaataagagagcggttttctcagacagagtcttgagactacaaaacagtcaagacatttccccaagcaaactcagaaaaatattaagcctagacaatgtagagcgttagtagttagggaatgcagtatttcaattccagatctaccatttataagctgtgtgtttttgggtaaggtactctgagacttagtgttctaatctgtaaaaggggataattccttccactggagttctaattaagactcattagggtgacgatggttgtaaagtgcttattgcagtacagtggagctgtttctgtcccagatcctttatcaaggattgagccaagcggaatccttgtctttgttagtccaaattggattccccattcctcaaggtcttgtatagcttaacttataactttcaaagcaagatatcctgacattgctgttttgaccttgacatttaaaccatgctttgaaattaagttttgtgtctttaccttgccagtagtatttgctccaagaagtaagtgcacaccaccagtctcaaattcagttcataatattgctgctaagaatgatgcacacaaaataaaacaagcaatggcaaaaactgggcacagtaaaatttgctggagataggaaattggctaaaagatcaaatattgctggcatcatgaaaaaccacaaaaaaatcctatgaagaattagacttggcagaaagaacgagagcaaaataaaattataatggccaaaactacatagaagaggttttattattgactagaaatcaatgcaaatataaaaaaagacttcctgtcaaaaatacacaaccgcaaaactggctttggcggactaaggctaccaaagaaaatccacaagtcagcagttgccattggtaaaatttaacttggcaaaaaacaatcaatgaaccaaatagttgacataaaatgtacacacagcacaattaatcctgatgaaaataattccagcaaagtaaaattgatttttttaattcagttgtttatgccatgtaggaaactgatcaatgacttaatttgacgtgataaagtttgctttgagaaacattggatgaacaatgttggaaaaagtctgactcattttattgctttgaaatatatataaaaagctagcaaggtccaaatgataggattaaaatatcctatactcattttaaatatacaatgcttagcaccagctggacacggtggctcacgcctgtaatcccagcactttgagaggccgaggcgggcagatcacgaggtcaggagttcgagaccagcctacccaacatgtcgaaaccctgtgtctactaaaaatacagagattagccaggtgcggtggcatgtgcctatagtcccagctactcaggaggctgatgcagcagactcacttgaacgcgggagccggaggtcacagcgagccaaaaccgtgtcattgcactccagcccgggcgacgaagcaagactccctccgtctcaaaaaaaaaaaaaaaaaaaaaaaaaagcctagcaccaaagtattagcaagttcctgttatttattaatgttctcatactttcattgaatttttaaacctaatgatgtttattttcaaacacttcagtccatttattattgaatataaaatgggtgctaattacaaatgggtcttatgtatgcccttgggttgtctagcaagatggtttcataggtagtaataagagcagcaagagaagaaaatagtgtggcctttacctttactgaacactcactttggaataggcctcatgcttgggactgcctccgtcagtgtgcagccttcagcggctacatttggaaatggtacaagtattaggttggcgcaaaaagtagttgcggttttgccactgaaagtaatggcaaatacttagaaatatttagaatatttagaaagtacctgctgttctgactatcttaattcagatgtgcactcaccttttggctcacgacaacaaaagccttcgaaattcctgcctgtttagtttgtgttgacacattgcagattcaactctgacatgttatttccttatgctgagggtgtcttgttgagtttcatgggttttgtgcttccctggtgccttattaggcttataactcacagagctatgagtttaaatgtcagggttgtcaccaaaacaatggagcaaaaagcaagttgttgacattctttggacgcaatttgcaatcccctttattttcctgtaacgtttttgtgtttccaggtgacagttgcccaccgaaccacagaaccacaaagcccagagttttagttacatactgctgctctaggatcagtagcccttaggtccaaaagccgtttctgatacagccttgggcaagctggttccttctctgagcctgggcccctgtcctataaagtaaaggtgttattacccttcataggattgttgtgagaacaaagtatttacattcttcatataatcagaacttttccaaaaacatgggatcttttacatggctcaacatgtttaaagctgtttatgttcatctgatattttaacattttgtagagtagaaaatgcttcaagcaaataaatgagctttatggtaattttttttgccagcatttagaagctggtggttaataaatactaatatgtatttagaagtttagaacagagatttttcagcaacaaccacaggctagatatagcccactacctgtttttgtcaataaagctttaatggaacataagcatggccattcattaatatatgatcaatagattttttttggtacaagggcagaattgagtagttgcaatacaaacagtgtggattacaatgcctaaaatatttactacctggttctttatagacaaaatttacagactcctgaggcagggttttatcaattcctttccatgtctatggatttagatataagcgtatattttgttaaatattacagcagactttgaggtggctatcatctccattttacagatgtagaggatcaggctcacaggtagtgaatggcagaaccaaggatgaattccagcccactaacgtcacatctctatttgatcattagcgtatagacttttggtccttcataaattttactttataaagatattttacgttgtataattgatgtcatggccatattgtttaatcatcactcaccatgcacctattgtgtggcaggcactattctatccattagggcacaatagtgaacgaaaaacttgctgccatcagagaacttgtgttctgggctttcatgcacctgccttgcaggcgtcaggaatctgaatcacactcattccctccatcacttggctcaccagtgggaccagacaggagtcctgcagtttcagcaatgaaccccagggcttggtgcctgctctggaggtggggaatggggttcacagtttagtggaagattgcctttagggagcactcttggtttctagaacctgatatagatgagggatgtaatgaattcgagtctgaatgtttatttgccatggacttctatctcacgactttgctataagggctacacgtcggaaatgggatctaagtaaacgtagagtccacaagtttcaggacttatatagatgagtgaatctcagattttcacgtgcatacagattacctgaggatcttgtaaaaaatgtagtttctgatttcaagtctctgggatagggcctaggactcagcatttataacgacatcctaagagatgctctgaggaccatactttgcatagcaagaaatgagaacagtccaggagcctctaagatccctcacatttgaggctagaagcatgtaacatgaatgggttctcaaacctaaaagtcagggcttgggcataaactaaaactgtgatcacctcgcgtagatttgaggctttgactggtcgtcaaccccacccacaaaagcctacagcttcctcctaccccaggtcccagcttctccacttctctccaactacctcccacttttcctcaatttcaggctctttcgtgcctccagcccagtctacagcatgttccctggttcagaccatcccaatcagacccctatagagatgccaagccattcgtttgtgggccgggcacggtggctcatgcctgtaatcccagcactttgggaggccgaggcgggcagatcatgaggtcaggagttggagaccagcccgaccaatatggtgagaccctgtctctactaaaaatacaaaaatgagttgggcatggtggtgcacccctgtaatcccagccacttgggaggctgaggcgggagaatcgcttgaacccaggaggcagaggttgcagtgagtcgagatcgcgtcattgcactccagactgggcgacaaagcgaaactgcatctcaaaaaaaaaaaaaaaaataagtgcttgtctctgctcaaagagaagtcagaaatggcagcaacattcctagcccaggctctgcactctcggtaatccctctgactgactctcaagtcttccccgtctgtctgctccgactgcacgagttggtgattaaactttaaaacaacaattagacccttgattttcaaagcaaacttggtttatagaccagacttcagcattcattacaatacagactaataaaaacaaatccggaaacatacgctttttaagctgtggtggtgtgaaatctgtaacagcattaaaaccattttgaaaaaaaaaaagtcatttgggaacccccagcaaaatactgtgtggatattcttttctattcctcattcaagtatattgcatatatataaacataatatatatgtttgttactgtaatttttctacttattatataacattttctatgttgctacatgatctttgtaaatattatttttaaagactgtacaatatttcatgtagttgacaagccacaatatttgtaaacataaaacatttctcccctgggaaatattttagtgatctccttcttcctttctctctcttcttctttcttccttctttccttcctttcttttctccttctcctcctctttgcttttccccctactccctttttctccatcttctgctatcagaaaaaaaaaaattccatgagcacttggtaaccatctactttatgttgaattatttcctagggtaaattctcagtcagtagtaggaggcatatttttcccattcaatgtagtttgagaagcccaatgaccaaatcatgagatgttgccattctctatgaaaatcacaaaggatgactccctaaatacattttatgtctacagagaaactgtataattctgacattaatttcagttccttacaactgccttcattccttggggagggtactgaaatgagctccagctggagactaagtcagctcaagccactaagtcatgggctggtcttgcacaaattattttctgtttctctgtttctgtaagcttacaatttatatattgtatattttataaacatacctcatcagataaggttatagtgaaaaatatatctgctagggtattcacttcataagggaaggcttttttgtctgttttgttcactacatactatatccccagcatctatagcagtgcctggcacatggtgggtgtataataactgtttgtttcatgattcattttttaaaagatctagaaaaagaaatctttactccaaagggtttgaagcagtgattcataagtattttaagaataaatgtatctttcacacctgtgtgcctataaatataatttcacaaataattctagtaagttcagagaatctagaaatttttttctgtgcataccaggcaatgctggcattaaaaatttattttgaaaatcctctaagttctaattcacttgacattatcctaccaagttaaagaaccatgaaataataagtaattcatatcactgcattcatttctcattatggactgtcaaaattgacattcttgttcccgttttatagaagcaaatcttagactcagaaaatttcaaagaacttatccaaagtgacacaattcttcaatagagagcagggactacaacctaaattttctaattcaagtccagtagggtctgccttaaatgcctcccactgtcaccgtgttgatttgtataacctttgtcttcctagcatttgattgacggctactgttagtacagatcatctgggctccttgtagtgatggacacattttcatgaggcaaggtcttagatgattaaaacaaggcagatgctaatgccatcctcaccttcatctggaactgtctaactagagttcgttaacttgtcagccctagttccttttgagcaccaggctgatataataaaatattgcaaatcaatagaagctttaaagaagcttcatctgtctttctttgttacttttttcctttcttcttcttttattactacttctttctttgccgctttaaagggaaaactgctatccctcttattggctgtacaattctgttttctctgtttattttgagttgttggaaattcaggtacatccaggttttcccaaatacacctattattaccccaaagagtaggaagccgatcttatctagattcactcaccaaatctagaatctcccaagagactccaaatttagtacattaatttttcttaagtataacattgctcagtaactatgtgggtgaagatctgaaagttctgcagcactgtttcatttataaaaataaaggtaacggtacttttgcgcaagatttgtgtggaatctaaaaacttccccaagttagtaaggaaggcactgtgatagtatctactaatgaaaatgtgagcacagagatggttataaaataccttatttttctcttcttcattattattgctcatttcatttgattagcaatttctagactcactcaacctccatctataaaagaaaccattagtctttgcctatgtctgctaaagcgaacttcttgttctgtctcatcttcattccctactcagtttctgtcttctccagcccttcttacattattgaaataattgactctatcaggtggatttctccagttgaacacatttggatttgtcctgtggaaacaccataagtacttttttttttttttttttttttttttttttttttttttgaggtggagtcttcgtcttttgccccggctggagtgccgtgagtggcacagtctaggctgactgcaacctccacctcccgggttcaagcgattctcctgcctcagcctactgagtagctgggattataggcacccaccaccatgcctggctaattttttgtatttttagtagagatgggatttcaccgtgttggccagcctggtctcgaactcctgacctcaggtgatccacctacctcggcctcccaaagtgctgggattacaggcatgaaccactgctcccagcccaccataagtactttaatatgctaatttatttcaaacaatatgggaatcagttcaaagcacatagtctcttccatgcacatcttcatgccggaatttgctaggcgcttgtacctccactcccttcttctcagtcctttgtccaaggaattcttccctcaaagagttctcagtcggaaagcatgtataagacaagaaaataaatggataccaaaatcaacaagtgaagtaaattcccagaaagcacttgcaatagtatatgataagaagtgggaactccgtaaaagaggcagaaaggaaatacctgaaaaggttaagcaagcgagtaatagcctggagagaagagttacagaaatgtttcatagaaaaggtgatctttgaggtgagcttttatgaataggcaaaatttgggtaaagaggtagacccatttttaagagcagggtgacatgaaaatctcaggatatattactcagcaattaatcctcattgttgtaacaaatagttacaaaattctcgttgcatggctctggcttaactgcaaagcaaagtagaaaatggagaagctcccaggcaaggccaacaacgcctggtctgtgctgcacgtgaagatatctgagcacttgtgacccctgctttgccctctttgtcattgcaatggggttactgggaaagcctctcccatggtggttgacaagagggaaactttgggaaatgttctcaggagtaacccacattattttcacgcctgaaagatgcaaggttggatagagagagaagttgggctgtggtacgcttacaacagagatctcaactgaccctgcagagagctttaagatgaggagaacccttctgtgttgtccttactcaggacaaggagctgaggtcttatgcctccacattgactagtcattgaatgtaggctcatttcaggaagggagtataatcttgggagaggtgctgtcttcagcagaaggcaaggcctcttagtttatagctgtcagcctccaacttcccagtggctgaaagaatgaatgcttcagttccaaataaagggatctgagcagcaaatcccatcgtcctgtattttcattgaagtagcatttcataaccagtaacaactgtcttcccctgaaagtgtggtttaaatttaaagttggtgacttccttctgacttgtcaaggcgtgggcatacgcaattttttcctctatggttatagcttccaaactgttagctatatagatacctactttttaagataagtgagacctcaatcacaattaactctgtaagttattgaaaaccggtttgatgatgatcatcatcatcctgtgtacaccttgtgtgagcttgaggtcctattgtaggattaatcatcagagcagtatctgcagtctgcagtgcatttcttcttctttatttgtttagaaaaatcccactcttcctcccaaaattaactttattgtcaacttgataagaagatttctgaacagaaataaaataaccctgatttgtggtgtttgccaattactgtggtataaatactcacactgtggctgatgccaagctacaaacatgacatcatggaattggaagaaatagtaaaaatcatttataccttctccaaaacactcactgttcccaaaactttcacctcaataattctgtccactggtatatcaacatggtactggtgtagtaatgatccattccaggtacggacaaaaaaagataaataaaacaacaaaaaacttactaaatgccatatggttttatcatcttgtgctggcaatttgtaaacatcatcagtgataaagtacttctcccaaatgggatgaatcatacctatcctcaccctgcttttggacactggtatatcctctcaaaggcattaataactatgttataatgcaaatatcacgttatctttctatgatttttctaacccaatagactgtgagttcttcaagcttatgtatttgggtacagaacacctcgccaaaatccttggcatatggtagatgctcaacacaggtgcactaacttgttagttgaagtgaccggtacaacctagttaactgaatcagaaccatgaattcagaggatagtagtaaaaaatcaagttcatgaagtttttaatgagcagtatgttttgcctaagactctatgattctcactgtggaatgaaccacatagactccagaatgtgtcttttcttaaaggcaatagaggcatgcagtgaataaaatgcactgagagaagcccataaaacaatattcgtaagtacagagaaaggcaatattaatgccaatttcaggggatctgttcaagttcaccggaaggcagagtttttagcaattttttaaaggttgaacatgtctttaggaggtagcaacaagacaaaggtccaggaagagggtgtgatgcagtggggaagcatgcagtcaccttgtgccgaacttaacaggtcaagaactccgtatgtgaataatggtggaaatatgtggagttacaggtacaactctgtaagggcattagcctgtaccagctatcattgcgtaccaggctatgtgtggactttgtccttgtgaatctggtaaaagttaatcatcaggtctcaggagttcagcaaccgaccatcatgagctatatagtattagtctgcagctctacctgagagcagcccagaaaccaaataggaatatatcagacattatcccagagagaaggctcagtcaaggatctgcagctgggacctgcatatcttaattcccctgttcctgggaaagttatccaatagctactgaaatacaagatggaaggtatcctctctgtaccatagctaaaggattgctcacaaaaatgaaagtgcaattacagaaaaattatccttgggctatgaccacatctcctgagtattttattgccaccacgactcatgatttcaattctcaggactgagtatctctgctgaacgcaaatttaaattcttaatatgagaagctgcgctttccagtcgtgtgtcaatgcaaagtgagcggatttgggtttaactcccttggactgagtgcaattatatgttgggaggggactaacaaggtagcccatgtaacaatactgtcgtaattatgtgcaatattttcatttttacttctgatcaaccgcaagagtagattgaatgctattgttcagtttgcacttaaaaatgatgatttttttatacctggagtttaacatctgagtttttgtttaaaggaaaaattgtccttgcctttgaaagttagggtcatgttaaaatatttactaattctcataaaatattttttttctgagcacggttgaaaataaaaatatcttggtcctgtcctttgaataatgtcaagattgagtgtacctctggagaaatattgatagagactcaaagcaataccactctcccttgtcacttttctctgtgtactgtggacaagttgctcaacctcattcaaactcagtttttctcaacaaaatttgatatcaccataaaggaggagactcggttgcctttgtttttattattaaaaggaagcattgagtctaactgatatgaaacatttctgtatatgcctaagaacttatgaagctcataggataagaattcttggcaatccaaataatctcacattgtctctaatctgttataatgctgctcttgcctcataacttttgttctttgtattccttaaaaagacctaagagagctcaagattatggggtgctgccaaatataacactagtcttctatttttatttttaaataaaactttgtaattggtaaagtcacagaatcagtgtgcatatgatcaaagtctataaaataatgaaccatgcataattgcagcagagttaccaaggaaggctgtaaggatgatctcactggtgcagccaataccccagtaatcaatatggatgcctgggtgacaactccttccttcctaactttcacagcttgcctgactgggatagccaaggaaggcatctgtgaagaggcagcatctttagagtttatgtgggaagtgcactctaggtaagacagatgctatatacaaaagcaggaaaatgtaaaatttgttcgtaaagagcaactagttgcatttgatctaaagtagatgattccagtacaaaaaggaaattacagaagttttctcagctccaattttagagagcctttaatatcatgctaagagggtagagtagaccacattccacaaagaagaaacagtattttatttgttcattccttcttacaaaaaatatccacctagtacctactctgtactagcttaaaggtaacttttgaaaaaaaaaattttataatgcctagtcaagaagcatatctggatggaatgaaggagaatgagacttcagggcaggaaagaaggcaagttaggatactattgggatggtccagataagagagagcaccgtctgaagggtctggcttataacaaagaggaaataatctttgagaccaaacagaaaagtgtagcctcaagaaatattctttgtcatcctagtggttgctttagaatttgtagtatacatctttaacttatcacagttcgtgttaaataatattatagcatttcatatatggtataagaaccttacagtaaaacactttcattttctcctttcccagcctttgcactactgctcctctggtttttagttgctcataggttgtaaactctacattacattgctattattttttactttaaacaatcaattttccttctaaacatagaaaaaggcatatttttccacatatacaccactttctgtgctcttcattcctttgtgtagattcatatatccatccaacattatttttggtttggatgaaggactattgaacatttcttacaatgaggttctgctggtgatgaattccttcgccttttgtatgtgcatctgaaaaagtcttacttttgctttcaataatgggagatatcttcactggatacagaattctgagttgacaaattttatttttctttgagcatttcaacggttcactccattatcttctgacttgcattgttgctaacaagacatctgctgtcattcttctctttttcctctgtgtgccatgtgtcttcttccctctagctgctctcaagaatttatttttattagtggttttgagcaatttgattatgataagaaacatttttgagtggagaatcaagggaaggttgaaacagataagacgtcaatgctgggaaaaaaggttaattgtgagactggttgttccttatttgagcctgataataacaatctcttcaggtacaggacaaatgtcatgacagaatgcactttaaaagaaaaataatagctaacacttgaagattgctatatatacctatgtgtgtgggtgtgtatgtatacatacacatatacatatatatgcacatacacacccacacacacatacataaagatagtgttcatacatataagatctaacttctaagatatataagatcctattctaacatatttaatatgttgcatatattagaatatatatttgaacagtatctcatacaaagtatgtttacacaaagtaggtgctctttaaatgttaactattacataaatgtacacacacacattttacactaaaaacaattctatgatgtaggtagtatgataatcttcattttacacattttttttaagatggagtttcactcttgtcacccaggctggagtgcaacggtgcaatctcagctcattgcagcctccgcctcctgggttcaagtgattctcctgcctcagcctccagagtagctgggattacaggcacctggcaccatgcctggctaatttttgcatttttagtagagacagggttttgccatgttggccaggctggtctcgaagtcctaacctcatgtgatctacctaactcagcctcccaaagtgctgggattataggtgtgagccaccgtgccgggcctctacatattacttctaatccttaacataacagcccatgattccactctttcaatctcgtttcttttaactttgaaccattctttgccaattactttacctacctgtgtctcagtttcttcatttgcatcatgaagctaataataaaaccaaaaggctgttttgagtattaaatgagataattcatttgaaaagtgctcagcatagcgccagacgcgggagagcactcagtaagagtgaggaggtggtactgttatcgctgctgttttatgctttcttctgcctgcgagttcccacttggttcattcaaagcacccacactgtcctacaaagccaagttagcatgcagcctactgccctgatcatgcagtcacaatctctgtttctgctaacagtcagtaaacacaatttagcatctcgatgggtttcattgctccacataggctcatttagacttttcaactagattaactcatcactcattcaattcgtgtgctgtctgaggacacaccaggtgccaaggactgttctggtttactagggttagaaaggtaaataagaaagataaaaattaaatccctgcctcatggatcttatgtatgggggtgggggagacaaacaaaaataatataaataagtaaaatatgtggtatgatagatgaaaacaagggacatagatacaaataaagcacagaagggaaataggaagtgttggggataccatatattttggataccgaggtcaaatttcactgtgtgggcaggattatctcacccatttcagaagagaggaaactgatgctcagagaagggtggtgaattttttcatttcatgcagcattggtttagagacaagatagaaatcaagattctccaacttacagtccaagacatatttctgtagcgggcagaagctgaactctatttgtgctcctaggtggaaaacaatggtcctgtagtcctcatcaccatttcccatgtctgaaactgtctttgtctacctcttttcagttcttctcaacttcataacctattcttgctgtatctaaaaagcattaatgatccactggcataagaattttgggttagctcaagccaggtaggatagacttgaccatatgttcgtgcaagttacaaacagccatccccttagggtatacacttgcagcacccatgggtgtgtggttgcagaacacagggtaaatttcagccctcagccacttcctgcagggacttttgtacagcgtacaacctttaccaccataaatggaggctttttgtatttcacacatcatttaactagtgaaagttgcataatagatactcagtgaatcatggatgattgaattctttctcatttttcatttcctatatgattcagatcctttatatttcagttcatggtaaaggacaaaaattatttgtcaaatattgattgagcacctactatatgccagacactggtctaggcacaggggtacagctgtggaaaactgacaaaaatccctgcatttatggggcttacatttataatatatatttatatatcatttgtctcttcttaatagaaaagtatatagaggtatgtatatatacatacatgcacatatactatatactataagtatatatacttatgtatacatatacatatacagatatatactttatgtgtattatatatagtgtattgtatacatgtttatatactatatatgtgtagtatatatagaacaccatatatatgcttatatactctatgtctattatatatagtaatgtatatatttagtatgttagattgtgatattgccaaaaaaaaaaagagtaaaataaagcacaggaggggaaatgaagtttgaaggatgttttagaaatactgggtagaggctgggcgtggtggctaatgcctctaagcccagcactttgggagaccgaggtgggtggaatcacatgaggtcaggagttcgagaccagcctggctaacatggccaaaccccatctctactaaaaatacaaaaattagctgggtgtcgttttgcatgcatgtcatcccagctactgaggaggctgaggaaggataatcaattgaacctgggaggcagaggttgcagtaagccgagatcgtgcccctgcactccagcctgggagagagagtgagatttcatctcaataaggaaatagtgggtagagtggccaggacagggctcatggagtaggtgacttgtgaggaaaggtctgaggaaagtgaaagaactgctgtggaagacagaaccaaggccccaggattgttcacattctactccttggaacctgtgaatgtgttaccttatatggccaaatagactttgcaaatgtgattcaagttaaggattttggattatgttgatgggtccaatgttatcaccagggtccttatgagagggaggtaatgtgtcagagccagaaagggatttgaagatgctacgctcctggctttgaagatgaaggaagggtccatgagccaaggaatgcaggcagcctttaacagttggagaaggcaaggataccttctggtgtacatcttccagaaggaacacagttctgatgacaccttgattttagcacaggaaggtctgtttgggacattcgaccccagaaatgtaagataataaatgtgtgttgttttaagtcgctgagtttgttatgacttgttatagcagccattggaaactaatacagcaattctgtggctatctggcggaagagatacccaggcagggagaccagcaaatctgcaggctctgaagtgggggtgggtctggtgtgctccaggatgccagtgtgcctggactgagctggagtgagtcaggggagcttgcagtaacaggggcagagtgcagatgacatgagattacatgacacactgtaacccggaacaaggacactggcttcactccaggtgctaggagatcgcactggaagctacgaagcagaggagggacatcacccagttcacgtttcaacaggaccgctctggccaccctgggggagggtggtgaggaagaggatgtagaggtatagtcaggagatgtggagcagttaggaggattgtgttttgatccaggaaaagatgattttggcttggagcaaggtggtgggaattggataagggtaagagggtaagaaatagttatattgtgaatgtattttgaagatggaggtcattaaccagaaaagggtaaatgtgatacatgtaggctgaactggaagagacagtgaataaaattcctttgctaattaaactttcttttttttttttctttttctttttttttttctttttcttttttttttttttttttttttgaggtggagtcctgctctgtcacccaggttggagtgcagtggcacaatctcagctcactgcagcctctgcctccctggttcaaacaattttcctgcctcagcttccgaagtagctgggattacaggagtgtgccaccacgcccagctaatttttgtatctttagtagagatggggttccaccatgttggctaggctggtctcaaactcctgatctcaagtgatccacccacctcaacctcccaaagtactgagattacaggcgttaactgaactttttttttttttttttttttgagacagtctggctctgttgcccgggatgaagtgctgtggcgtgaactcagctctcactgcaaccagtgcctccaggttcaagcaattctcctgcctcagcctactgagtagctgggactacaggcacgtgccaccacgcccggctgatttttatatttttagtagagatggggtttcaccatgttggccaggctggtgtcgaactcctgacctcaagtgatccacccacctcggcctcccaaagtactgagattacaggcatgagccaccgtgcccggctaattaaacttttaatgtggaaagacagcacatgcaggagataagaggtagagtgggtgatggtccaggctctgagcggaatggcctgtgttcaaatgctggcttctctaacttaccagaattacgtatgtccttgagcagagtgtttaaccttcctgtgcctcactttcctcatctgtagtatgggatacatcacagaaattgtgtatcaaagggggaaaatgtttgcaagacttagtgcctaattcacagtaagtgctcaaaaaatgcacacagtaagtgctctgtcattttctagaacacattgatgtttaaaaaaattttcctacttgtaaaacagtcaaagagttcagtgtgaagtatttgcaaaaaatttgaaataaaaaattactcctttcctgtggggcaagttcacagaatagctggtatgctgacaattttctcttggtcccataatagtttttcagagtttcattataaaatagttgctgtatttgccaatgcagactttgaagaaggagactgatccttctggcttttaaagaagaatgagtattacacgaccattgaatatttataacactctcttctctttttaaagctgttgttgttttaccatcctaacatcaaaaccactgggcccagggaaacctcagatgtgggagaatatcaaatgtggaacttttccttgtttttcctggtggatctgacacaccttggaaccttcaaagaacacagtaatcaatgacgtggggagacgtgagacatcgcatacattattgtgaagaatttattaatgtaaactgcatggtgtggaatagaggttggggctgaatgaaaatgtgaggctctgtaatgcgacaaaaaacacagagcagagagaagagagaggccaatgaaagacactttgctgatttgggacttcactaaagagagccacataaaagagaaattattgtttaagtaggttaaggcaaccctagtgttttaattaaaatgtctttagcaaaaaaggaagaagaatagtacttgaggtttggggaaggcttcagtgaaagaagaaatgtaccaggcggtggcgggggtgggcgggggaaatagtgtaatttaggttaaatattgtgaataactccccaagccgaataatgttgaatttcagtcgtaggagatatttaagaattggttgaacaaagggggcaattgactttggtggttagtgtgggagacagctttctaattttagagtttgcagccataacattatgaagctaacgaacaaaaacaagccatgtagataaaaccaggagaaataaggatctgaaaaatggaccaaatcgatcgagttctggcaatgagtgcttccttttcgtaaatacaagggcagtgctctgcatcttctccctctctcattttctctgagaaaggaacgtgccattcttttttctctctctcttttggcattcctttttttaacttttaagttccggggtacacgcacaggatgtgcaggtttgttacataggtaaacgtgtgccatggcggtttgctgcacccgtcaacccatcacctagatatgaagcccagcatgcattagctattttaagaggaggatcgatttcaccctttttggaaaactcaatctggggcctgctttccccaggatcaccgtaagattctacctgaggagctgagttttcctaagaatgaaaaagcaaagagacccctggttttgtatttgatacaaagtcaaacgctgtttttctctgagtctgtcctggaataatccagtgacatccaccatcatctgcatctcccatggaaccaccacatgtgaagtcgaggctgagcgcagggtggctgcaccatccacatcaacagccagcactgccttctgccagtttatgaggcaattcggctgccagggagaggagaacagtgtcccttccaatccgatgagtaaatgcctcaggtgttaggtaaaaccccaaggtttttctcttctctggggccaccctcaggaaaggaaaactccaaaaacttctttgggaaaaagaaaaaagaggttgccatgtgatattagatggcatgaattaaatagatactacttattaaagttaaaaaaaaaataaagcctgcatttgcatggtaatgggacctggcagatgaaaccagaaattgatagaaaccacccccaaatcatcatctaacctgtactgaagaatgacgcacataatgtacaacaggcagccattgtcatgtgtgtgtatgtctgtgtgtatctgtgttatcaggcaggtagtgaagaccaggagggagaaagtagtgagtcagcgaagatggtatcccagttagagaaacgacacaatgaaggcatgaagtcatgagacagtgtggcatgtttgggcaacacagatgtggttgggaccacaaaagttgtgatcaaggaaatgtgttggaacaatgtccgccttcacaagattaaatttgtttccagtgatgattttattccactggtgggttatttgtcaatatgttacaggacttttaaaatgttcataacctttgatccagtaacacctcttttgctaatctattctaaggaattctcattacagaaaaacaagcaaaagcaaatgaaactctacctacaacgtcactttatttgcctttcatttatagtaagaaacaattggaagcacttaacatacaagcaggccaggcaccatggctcatgcctgtaatcccagcactttgggaggccaaggcaagtggatcatgaggtcaggagttcgagacgagcctggccaacgttgtgaaaccctgtctctactaaagatacaaaaaaaattagctgggcatggtggcatgtgcctgtaatcccagctacctgggaggctgaggcaggagaataactagaatccaggaagcagaggttgcggtgggccgagatcacgccattgcactccagcctgggcgacaaggcgagactccacctcaaacaaaacaaaacaaaacaatacaaaacaaaaaaacaagcatatcaagggaatgatttaatacatgttgatacatccacaagatgtattgtgccgcaactaaaattatgtttacagaatctttgacgtgggaggaaagaaaacttgggaagtatcattaggttcaaaaaccaaaatacaaaactgctcacacccttccacttcaacttaaacaaaaagtatattacaacctggaaggaagtccactaaaatgctattctgtttgtctgatacaggatggtaaataaatttacttttcttctgtgttttaatatattttttggagtttctctgatgaacctattctatgtggatgattttttttttaaaaaagtataatctggtgtggcagtatgagcccaacatatagtgcatccctcctaccgaatgctaagctaaaactctgggcagacacacactcaagtgcatgcacaccccacacacagacagacagacacacacacacatttgaaaaatgtgaagagcaaaccaaagcagttgggtaggtggattgaagagagtcaaaacttggagaggtgatttcactgagaagagtttcctacattaggttatttttttcttcttaggctttgccttgggactgggttctagtcatactgcagggggttggccaggcaggtagctaagagtcccgttgaatttccaaccttctggccagagaaaccaggaaaagggacccctatggggaaattttgaaaaagagttcgttggggttggtggtggttgtggtggtggtggtggtggtgattctctcctcagctagtataaatagtttggtacataataggtgctcaataaatacttgttgactaaatgaattaaatttttgagaaaaaaatccaccttggagattgacacactatcttccaggtagaccaatgcagccttctttccagtacaggacaagttctgtttctccactggacaccagaggaagtagtttgcatttaggagggtttcatctgaaaaatagggaaactcctatgtttacacactagagtcctcttcagtgcaatgagcattcacagtatgagaggctgaggaactgaaaacaggtgaagagacagctgaattctctttctctctgtgtattgattctggagcatttgcgtagtgagtggaattttaggtgggttttttttttttttttacaatcacataattcattcctctgactctttgtccctcctcttttcttttcttttttcttttcttttccttttgcttttcttttcttgagacggcatctcgctctgttgcccaggctggagtgcattggtgtgatctcggctcactgcaacatccgcctgctggattcaagcaattccctgcctcagcctcccgattagcaggaattacaggtgcctgccaccacagccacccagctaatttttgtatttttagtagagacggggtttcaccatcttggacaggctggtcttgactccctgacctcgtgatccacccaccttggcctcccaaagtgctgggattacagacatgagccaccgcgcccagcccctctttttctttttatctctttctcttccttcattccccgggtatgtagttaaggccatggttgtgaagtatccgcatgatgcatctccactatacaccgtgcttgtggcaatggaggaggcaaaggaccacagaggaaggacccttaggtggaaaagccaactctgtccatgccccacctgtaaatgtttgtgttgcagaactttccccttagttcagctaaaactgagttcttgtcaaacaaccaggaaagactgggctcacagccacataaaagggtgagaaacagaagttattggacaaaaaggaataataactctcagcaaagcgagaaagggtcctgcttgcaggtctcccgcctcatagattgaatcccaggttaccacagaaacaagagaggccaggctcctccccactgcaaagggcacaaacttccttaggctccaccccatcctcccagtgcacaggtgggcattatatagaaagagttggtcgggaaagggtgggcttcatccaggaccagcagtccagtttttcagccttcaggctattttaggctcgaaggcagggttttgctggggacccttggctgtctcttgtctgtatcacttaggctttgcagttagaacacatcaggccagtctctgcatttatttgccttatcacaagcctagagaatgtgtacccatccctaggagagtcctcagtaaatgactgatgggagctgggatataaatcccccagctcccttgcccttccgagtcacaggttctgccctgcctcctggaattctccagtgggaatgtacttgttaatgcttccctcatcagctcccttcccctccctgcctcacttcctcattctcctgcccacatttcctgggatgacccaccaataaagtacttgctgttaaatcctcaatcttagggtctgctcctggggagcacagactaagagtattgaggtcctggttgtcctgattctactatccagtgggctcatgtacaaaaaggaaaccagaagtcacgaggatccctcaggtggcctacagtaaagcagggaaaagatgaggatcatagcagggaatgtggtcataaagagggaagggatggattcctgggaaattttcccaggtggaatctgtaggacttggcaaccgctcgtgagtgcagtatggtgggaaccaaagaagcctttcatacgatgtgagtgtctaacccctcaactgctgagaaaagggatgcaggaaaccccatggctttggaaggagtaagtgggaagggccggattttcagttaagtttaggatatgttgagttttaggtgcctgtggatagtcatgtatcatttatggtgacagtgccacagggaaggtatgtgtcaaacccctaataaatacccactgaattgaaaataattctttttccaagtgcgggttttctaacaggggccagccagacatttatgagctcaggcagatgaggaaagcatgatacctggatcacgtgtgctcacatctggaatacatgcgcaaattaacacagctgtggaggcaggagtacatatgtgtattagaaaaacaagccccacctgtagagcgctgcaagatgcctccagctggtcacaagtagctattgaacatgaatattttatcagtgccagagcagatagagggaaactgtatccattatattctcatcaccatcacatgtggttgaacgggcttccgactaaagaatctaaacatgtttaaaacatttttcacctccagtaaaactagcaagtcttgatttgtgttgttattgctcctgctagattcgtgaaatatttcagaggcaattgcatcttggaagtgtggtttggcaaattttcatccaaagcgtatgtttttgttttattttttaactagcggttcaaacgtggggaagttgacattttagagcaaatggtagaatatgtggggttattttctgttgctgtttcatttttaggttcaacttttcaaatatagagctggattaagtctcactagtagcagaaaacaaagtctgtttaagtaaatgtgttttcaggatggcccaactgtacagaaacttgcagatctcacgttctgatcactccatcaactgctgcttctttaaaatactcaagagtcacttacgatgtttaattggcatgtctgtctttcaaaatgaaaagctacagggtagcttgtgttaaccacacaacagctggttttggtcacttggtaggtgacaatccagtgaccacaaccaaggaggatttaacaagggattttatgccttgcaatgcggaagagcactggggaaagttcccgaaggggtgcctcccagaacacaaatgaaaacagggcttttactgggctggcgagctgagtcactgtatgtagaggtgtagtgaaggcagcacatgctcagtcaccgatcatgctgctacatacttgtacatacttactgtctatacattactcactcatgtataggcagtggtgaataagctcctccctgggcctggttagtagtatggtaatacagatagataaccgaagtacatttccaactcagacatctctggatccaaccagcttttgttttgccagggtcgggcttctttctgaaatttttgaaacaaaaaaaaccaaggtgtgacagttacaaggggctacttcttcacagtgcataccccaaaaccttgggaccctggagcatacccccaaaaccctgggaccttgggttagacttggacttttcctgttttcttgttactcagcaaccaccacaatgcctggtccgtggaaaatggtcaataaatatctgttggctggataaattaatccctaaatgtatgtattaggttgttgcaaaaaaaaaaaaaaaaaaaattagccgggcgtggtgtcgggtgcctgtagtcccagctactcgggaggctgaggcaggagaatggcgtgaacccgggaggcggagcttgcagtgagccgagatgacgccactgcactccagcctgggcgacagagcgggactccgtctcaaaaaaaaaagaaaaaaatagaaatggcaaggaataaaatttgccttcaatgtgcttatggtcttgggaggagtagagtaaaaaaaatccctaatttctattgatataatatcattggatagtgccatgatagaagaatgtcccatgtgcagtgagaatctagagagaaaataagtgattacacttaaagtagagagtcagggaagacttcctgggagaggtgacatttagactaaagcataaataatattgatttgtttgccaaatggaggaagcaaagaaggatcctgagtgaaagcatgatgtgtctgaggatttgcaagtcgatcatgaggttgcagcatacatcacatgggagagagttgctgactcttcaggagagcagatcatggtatgctaggacaatcagagtctccactagagcatatgaagggcttaacataagggagtgtcataattacatttatgtttggtcagagcactcaggcattggattggagaatggagttgagatgagaagcagtgaagcacttgctgtagccatcataaaaacctggatcatatcaatagatcgtcataacttggcttcaacaagaattcataaaaccaactcctctctatttcatagtttcatcattttatggaatatcaaaaacctaaagagaaagagaaataaaaataaactatatgaacttctccctgatgaagcattcagtcttgttttcctggatctcatgcatgttaaatacatatttagatctaagccactatatcaaggaagtgaaaaactcttattccttaaatatcaatatgtgcacaaattttcttatacccacataattttagtaaaactttggagaaaaaagtttccagagttctagggctttgttccatttttggaaacagtaattttagaactctctgctttgctttacttattcattttatctcccgctgggtttccttcttgatttctatacctttgtgtctgcattaattaatttttctttcatttattcacacatgcaaccattgtgtatttggtctatgtatcagttagggcaggctaattactctagcaaaccagcagttaacaagaaaccaatcccgttggcagggaactgcactgtgtgaagacattcagagatccaggctccatctatcctaaagcaagcaaacaggctttgagagggagacagagacagagacacagaaagacagagagaaaaagagagaggaagttcttggtgattagaaatttgtgtttctgtgcggtatgtgtatacacaggtggtatttttctatttggagggcttaatgtgtttttaggtgtttgtgggttaggagttagaagaaatagccaaaaaggaggtgtaattaaccctttatctctttctcttgatgggtaatgtggttacttcctttttgttagtttccccataatattatagtaaatacctgagtgtattatgtgtgtgtattttgattatttctctgcactgtgttcctagtagttaaattacttagtcaaaaagcatgaacactttaaaggctatcaaacatagttacattgtttttcagtaaaatatctgtacctttttctttagcatcgaggtatctatttaccagaccttcgtgagcaccgtgcagtttattttttaaaaatatttctcaactttatagtcagtatatttggctattaggataatttcaggatatttgaggaggaactttaagaccggcttataaattacagcacttataaaggaggaaaacatgtggaactcatgtctggtacacatgattctaggaactggtggtgtttggatggcagaagttacaaggaacgcaaaagcagggagcgtgagccaacaccagattgacctcaggcagctgatgctatcgaaggaaaaagggaggacttccatgcaactccagaaaacaaaaccaagacacctgcggtagattctggtttaacaaaagggagaattttctaaaaattttctatagatttggttacttcacaaagcattgagcaccccaggataaaagaatccaactgagagtggcagctttactcttattagagagaagatttctctattaaagacaaaatcaaagcgaaatcaccaacatcttactcatttacttattagacacaatcgtggagcaaatactctgcaccagctactgtgctaactccgttacctggattactcaaattcttacaataactctatatttatttcataattgctttatttagtaatattttaagtgctttttagacacctgctctatgcctgtcttgtgctaggcaccagggggcgtagcagcagaccaggaaaatgtagagtctgcccttacggagctgggagccttgcatgaaagactggcactgacgacacagtggcactgaatgaacgtgtgatcagaagctgagacagggctctaggggaaaaaggcaaagtgcagccaatcctcatagcaaaagagaccgaggaagcctagaagtggtgcttgagtggagagtagaaggatgggtggggggttaaccaggcacaagaggggagggacgggaagggaagtcacaaggtgagaagccctcagacaagcacctgcaattggagggtgcgtgcagctgagaagcagagccaggaggacagtgatagcacttgaggtcagagtggtcatcgggatccaagcctgctggatcttcctggccttaggaaacccagaggcttcatcctttggcaaggggaagcctatataccctgtaggcttaatgacggggagaagaatgtttgtaaaagatctcgctggctgctgaagagagaacatctggagttaactctccaatttcagactcccctgatgaaaactgttacttctgttctccactcccttatttgggcaaagcagtttattttctacccgaagcatatctactaatagaaatgactgagatattcattacgttaggaatgtaatgtaatgattcttagatggtgattcagatgattagttattggaccttcgatgcattttttattttaattttgagattggccgtccccaacgcctctgatgtgtgactttcattactggagatgttgtttctgatgttgctggcggtccctactgaaaaggatgcatgcatgaagactcaaggcaacagtgacttgcacccatttctaacaatgacttgcacccatttctcccgtatgggggtgcttgataagcactgagtggtgtaatttacaacagcttattggcttgatgccatcctatgaatccaccaaccatcatcttctctgaccctttaaaatgacttccctcacaccccctgccatgagatgatatgaagaactaacaacagataatttctatatcaccacattttattatcagcataattctatacagtaaatctgcagtgggtgacttagttttgctgatatgtggcctctagaatattgggaaaatagatacatggaaatttagggagcttgtatcttgcctctccaaccttttaaatttgctgcagaaagttggatatttgttgggtttttcttccttaagtaggcaaacttcagccccaggaggcaatgaagcaaactttaaatgtagccccaggtacttcaaagctggctgaaccatgtgtttgattgcatacaaaatgtgaattgagtagcacagaactgtcctcctagcaactttgtagcacaatgagatcagctgcaagaacggaataaattggagattggcttctgcagttccattcatttgcaaaaatttgcagacaattaagctgtccccctgcagtataggtagctccttttagccaggggctggagatttgttctctctgggaaaatgttaaagctgtgattatctagttatacctgaataaatggatcaaaggacctctccagccaagcacagacctccttgaaaaggtagtctccagcagcaaccctggggaggtttatagcaaagtgtttttagagcagatggttctggagttacagaggccaaagagctgaatgacttgggatgagtcttttacatcttttaacttcaggaaaacagccatggtggttctgccagcaagtcgttgaatggattaagtgagataatcatacaatgtgtttagcactgtgcctggcatgtaataaatactcaataaatggcagtattttctatggcagacttggtgaatccaggactaggatcccaggcaaatcttagggttataaaggttagaaggaaccaggttatgtcatcttgagtctagaatataagcttcaaactctccaaaggaataaccctcaggtccttgaactcaaacccgaagcatcacatctttgcgtgaagcctgcaaaggctcgctattgccttggaagcaaatccagtcttcttaccttgacttacaagactgtccataattgggctgggctgactgcatgagtctcacctttcactgttctcccttaattccctgcctgcctggaagacgtatttcagcttctgcaatgctttgccttgctaaaaatatctcctcttagcaaacaagtttgcccagaagttatgaaagtaggagagggaacaaagatgatagaggtttgtggtttgtttatgaggttttcactatttctccctatcactttttctattatgcaaagccagggtccaggagggcagaaagagggaatgaggacaaattatctggacactgtttgtctgtttgaatgtcagcgtatttaggagatcctccaacaggtggccagcccgggtcaagctgcgtctggccttgtgttcaggtgtgcaggaagtaggatcattcctctcaaatctcaccacttccttcagttggctgttagggaaggcttttatgcccttggctgggtgtgacggaaaggggcagggacagacaaaacttggagtgcggtcccagctgtagaatgccagtctggcagacataacaaaagtgagcacttcttcgcttttgggacaccttccccatttggtcttgacattgagcaccatgctttggcaggtgtcagaggttggctcccgggaaatagaccacgcaaccggggaggtgttatcagcatccatacctcacggggagggaggtcagggggatggggcggggaaggaggctgatggaggagttgctgactgcaggtagctggaggcctcagccttcctgggcagcagggatacgggcagggatgtcccctgagcatggtcccacctggaagccagggggctgaccttgacacactcctgaccagtcagtggatggcgctgcagccccttctgtttagtcttcacatcagcaatgaaagagggtgaagttcatggaaatattgtggggacatatcgcatggtttctgttcatgaaatgtccagaaaagacaaacatatacagccagtggctgtggtaaagtgggaatgactgctaatgggcatgaggtttcatttaagggtgatggagatgttctaaaattatatgtggtgaggattgcacaactctgtaaatttcctaacaatcactgtgttacacacttaaaacgggtgaatttcatggtacgtaaattatacctcaataatacttttaaaatactgcaggcgagaggggctccagccagagaaattgactccaactctccctttccacaaatcaaatgctcagatttgcattgtgggaggagcctgagtgttcactgcaggacaatgtaggttcttcagggagtgcagaccactttcacatgcagcttctcatttcgttctgataacctagaggacgggcaaatcatcgtaggacgatgagcgctgagctacagtgaatgtagcttgttatcttacgacagacctgggagaaggaggaaatccaactaatttatttacttttatccctttgagtctattctccacaaagcagctatgatctgttttattgcaactggactcctcagctcaaaacccttccagggctcactcctcatgcggagtaaaagccagggccctctccatggcctacgtgcctctccagggtctgacttcccttcaccaggtccagactgtctccttcacctcacagcgctcaccttgcccacgccagcagctgccacactgaagctccgccatgcccggtaggcttctgctgctggcagtgcctcctcctcctgcccccttggcccattcttcctccatcttccactgccatctcctcggtggaccgcttcttgcctccctgtctaaaacatcagcaccctctccccctgagcacttccagccctcctccctgctgatcttttttctcttgagccatatgtgttctctttccctttctgtggtttgccccctctctctacaattgaagcttcatgagggcacttgcttcttttaggcactgcaccatccgagatgcctagaattatacctggcagagagaaagggcttggttgatacgttttgaagaaatgaatgaaagaatgaatgaatgacttagttaatatgaatctattctctcgctccttctcacgttctttttctcttcctgccttcctgtttccctgggcctccaccctcccttcccaccctcaacccctcccctgcccctcactgtttcaggggtctcccctttatttctgatatgtgttctttggggcgagtgttgtggtgcttccagacagcgtgatacttgcttcccctgagattgggaaacagggaggaaagcaaatgaggttttaacctcaaatgccctaagacaggaagatgaagaccttgcttagctgcatgaaaccggagatctttgtgtagggatgacagtcctcctctaatagaatccagcatgcgtgaggctccctgaagacacaacactgcccctgtgatggaagcaaggctggatgaggctgcagcaggcctcggatgacctaggctaaagatgctgcggatcactgtccggagactgctgtggggggaatcccacaagtcacacatggtctggtgttggtggcggccccagaacctcactctcctctgcacacctctgcgtgcctacgtctgttcctgtgactgaggggattgtgttcagcacactggaagtgcgaagacgtgtggcatatgtccgtgggtctaggcagctgatgcatgtctgttgcatgtacatctgctcgtgagtgtgtgtgtatgtgtgtctatcagatggattctggtgtgtgtgtaaacccgcatgtgcataagtgtgtgcatttgatgtcacagagaacatttgacatctgcacgcgtctagtaaatctggaaagctggaaggggctgcgtgtctacatgtgtctgtgtttcagatctggccttaggccatccacagccgaattactcactcctgatacagactgagtggctcaccctcattttctcacttcctccgtcctggtgttaataagactcatccttcatttttctaccgtttctgcagttctttagagagtgcagaccactttcacatgcagcttctcatttcattctcataacctagaggacgggcacattatcctcctttacagatgagaaaatttccttcaacccctctgtgtcctgtctcgaggggagcagtattgggcctcttctctgaggctgatgtaactgctgattcctctcacacctcctgtgggcatctcctctgctctcttgcatcttcattcattctgtgtttctttcttcaccactgtgctttctttcctctgaccccttcttcctcaaggtcagccccattccttgtctcccatttaactgaagaacttctttccatagctctccttttcttctatgccagagtcctcactgtccatgtaatcgcctagcacacaccaaaagctgctctttctaaattcagccgtcatctgttcatggtcaagcctagcagcctccgtgattttggaggagacctctgccttgtgtaacgtggctgtgcactgttcctttttggaattctcctctctgtgcttctggtttttctgctacgctgactaaactttctgtggcctttgctgaaactcatcagatggttacgttcctcccttttcccttttccctcttcccataatctgggttgtgccattgtctccatgtcttgcagctactcttgtatatgagtgattgtgacatttgtctccctcctgaatgcaattcctcatgtcccctagaaatctctgcttcacgtccagcaggctcctcaacgtcaacaggtctactctagcactggtaccccaaaatgcctttttaaaagcctttgcccacttggtaatggcaacaccagaagtcaagagatcttattacctccctcctttacgctgatcttcagttctttcccatacactgctcttctgccttttgtaactgtctcttgaattgattacattatttttgtcaccaccatttttgtgttgtccttctctgagtttctggccacggattggcaccctcacaggcttcatgcatgaaatgacagatgcaagtacaccacacgcacaaacacagagagttgtcccgaagcagggtatatggatgtcagtcaaatcatgtatgatggttcttacacggtcccagtcatacagaaacatatggcagaacacacaaactcattagcacagactcgatcaaaggtgggtacagccacaaatatagaagtagacacttggccacaaacacatacttatagatatacacataaatcacaggcaaagatagaagcagagccacaggcccagaaacgcagagccatggataaatattcactgaagtttctcctaatgtcagacaaaaacttaagcatcagaagaagcaggatgtcctgacttcagtcgttccttaagatgcccaccgtgacgggcccagagagtcgacatgcacatggtgacttctctacaatcaatacctccagcagcccccgaaccctgtcccttccaggtactgtttttcccgaatcagagcttcctgcttcttttcttgggcactttagatccacggattaacacaattgtgccacttgccatacttctgggatgcgccgtaataatcaaggaaatggatgggcagctgtggagttgatgagctggtgagctgggaggacaccagaggtaggatggggatgggattcagggagctgaccactctggacacccgtgaggacagaaatatcacccatttgtgggtatgaaaacacaagaaagcaattcatgacactctatgcaaggttcattattgatgacacggtgtgctttgtcattactttggacacatttagacatacattgtcatcatgaactgaggcctatgtttgctctaggatgaagcccattcaccagtcctttacatctgcacaaagtttacgtctttttaaagtgtttctctagaccagctctcatctgaggctcaagatatttttttaataatgaatgatattcagatattacaaatatattttacgtatttcctatttttgccacccttaacaaaccaacagaatcttcatagatgttaaatatcagttttgtgtaaatacaacgcgctctaattttctttcttttttttttttttttctgagatggagtctcaccgtgtcacccaggctggagtacagtggcgcgatctcagctcactgcaacttccatctcccaggttcaagtgattctcctgcctcatcctcccgagtagctgggattacaggcaggtgccaccacacctagctaatttttgtatttttggtagagacggggtttcaccttgttggtcagcctggtctcgaactcctgacctcgtgatcctcccgcctcggcctcccaaagtgctgggattacaggcgtgatccgctgcgcccagccaatgctgtttctttgtttagtgttgggttcgttttgggtggttggcttttttgttcgttttgttatattattcttgctttttcttctgtcttatacagaatctagttttctttgcctgcatattgagtccttttcacttcctagagactaaagtgtctcttacttagtctctttcattgagattttaatattcttctgtgatcactatagtgtatacaaaatagaatgcattgaatatgatattctatattttcctacatagcttgtcttaaatattctctctgctagctaggtaaattggagcagtttgcatgcaacctctctgaactttcttcattgattaaggagggataagatttactttggaggtctgttggaaatatttgagggggctcatgccaagtgcccagcacattggccagcatacgcttgctgtatcattattatagtagtttagagtagtgatggtgagggcattggagtgatgatgatagtggtcggaacatggtcttcacagttgccttattggtcatagcctaggagtattgcctactaacaaacccaaatgtaactttgtccctgctatggaacatttaggatgttttccatttttgccccttataaatcatgtctcactaaacgtcttccttcatacagttttattcttcttttgaatgtaacgtttggatgggttcctagcagtaaaattactgagtgaagggatatgtgcattcataaagctctcgataaatgaatattgcctgattacttttcacaagggtgctatgaatttatactcccacccaaatcaagagaatggctatttatagatgctttcagagccttagcttatcttgtttcctgtttgaactttattacataaattttcctttaaaactgtcacacacacacacacacacacacacacacacacttttatggggccttggggccaaagatggaatgaaactatcatttatcacatgattttgataggaagctgttgttaggattgagatgcttgcttctgatgatgcagaagacagttttaattagtatgtggcattaaataagatcagtttgcatattggaaatgatattctttttcaattatctttcagtcctctgatcagatcaaagaggaagtctcagcttggtgctaacacgcctttaacaccgctctggcccctttttacctgtaagatgaagagctttccataggcaacagtttctagctcaaatttaatggtgtcattaggtctccagcatgtttatttttatgttttccttcttttatgtgaagtgatactaatgttttatttaaaatgatacaaagttttcattttgaacacatttaattaaaaatatgagttacgcatagagcaaacaccctgacagtgtcactccaataactgaacttgtgacatgctacttggagagtgcattccaacagttgccccactgatcatataataacaacacgtttcccttgacaatacactgaatacaagtctccataatgcctgacatagtttgggactttgtgattgtccctttatccctattcatttgtgagtgtaaggaccttgcagtggctcatgaagagagttgctttttattttttatttttaaaattttttttgaagactcttaacaaagtataaccattttgaaaatgcctatctattaccctagataaaaattacctagtatcggaagagtatctaaaaagatattcaaggggtacaagtgcaggcttcttacatgcacacactgtgtagtgggaagtgtggccttttagtgaacccatcacccaaagagtgaacgttgtacccaacaggtgatttttcagctctcaccctcctcccaccctcccactttccgaagtccccactgtctcttattccactctgtatgttcacaagtacccattgttgagctcccaccaaaaagtgaaaatatgcggcatttttctgtttgagttatttcctttggatcatgtcttccggcttcatccatgtggctgcaaaagacatgattttattctttttttaggcttgagtagtattttatggcatgtgcgtgtgtgtgtatgagtatgtgtgtgtgtatatatgtttttgtgtgtgtacacatctttatagatatgtttatatatacgtatagatatatttacatatatgtatagatacaaatatatatatatatatcccacattttctttttttcttttttgagactgattttcactcttgttgcccaggctggagtgcaatggcgcgatctcggctcactgcaacctctgactcttgggttcaagtgattctcctgcctcagcctcatgaatagctgggattacaggcatgcaccaccatgcccggctaattttgtatttttagtagagacgaggtttctccatgttggtcaggctggtctcaaactcccaacctcaggttatccaccctcctcagcctcccaaagggctgggattacaggcgtgagccactgcatctggccccacatttttttttatcctgtcttctgttgatggacacttaggttcattccatgtctttgctattgtgaatagtgctatgataaacacacaagtgcaggtattgttttgatataacgattccttttcctttgtgtatatacctggtagtgggattgctaggttgaatggtagttctgttttcagttctttgagaaatcatcatactgtttttcatagagtttgcactaatttacactcccaccaacagtatataagcattcttttttctcttcagcctcaccaatatttgttgtttaagactttttaatcatagccattctgactggtataagatgatatcgcattgtcgtttcaatttgcatttctctgatgattagtgatattgagcatttttcatatgtctgttggcccgtcgtacgtgtccttttgaagaatgtctgttcatgttgtttgccccactttcttttgtttgtttgtttgttctgagctggagtctcgttctgtcacccaggatggagttcagtggtgtaatcttggctcactgcactgtccgcctcctgggttcaagcaattctcctgcctcagcctccctagtagctgggattacaggtacctgccaccatgcctggctaatttttgtgtttttagttgagacctggtttcaccatgttggccaggctggtctcgaactcctgacctcaggagatcggcctgccctggcctcccaaagtgctgggattataggtgtgagccaccgcacccggcctacccacttttaattgggtcatttttgttgtttgagttccttgtaaattctggataatagtcctttgttgaatacatactttacaaatatttttcccattctctaggttatctgcttagtctgttgattgcttattttgctgtgcagaagcttttaagtttaattaaatttgaattgtccatttttttttttttttggtcatgtttgcttttgaggactaggccataaatcctttgccgaggccaatatctggaagagtttttcctagggtttcttctagaatttttatagttgcaggtcttatgtttaggtctttaatccatcttgagttaatttttgtatatggtgaaagctgtgggtccaatttcactcttaggtatatgattatccaattttccatatgggtgtttaggccaacaccatttattgaatagagcgtcatttccctatcatatatttttgccgactttcttgaagatcagttggttgtaggtatgtggctttagttctggattctctgttctgttccattaatctagatttataccagtaccatcctgttttggttactatagctttgtagtataatttgaagtcaggcaatatgatgcatctaacttagttcttttcacttaggatttgttataaaaccaattctttattggctgtaaatcaaataaaattttatatctaagcaagtcctccagattcctgaccaggtgagtaatccagtagcttggcagattaagaacagcaatatgcaagcaatgagggatgagtaaatcaagactgtcattgtgaatagaatgatttggaagttgggtgttcaaatagcttaatgatagttatagtgaataacaatgtcagctttagtattattctagtaatgtacttggtaatgctaatagggtttgatggaatacagtgaacactttccaaacagctgtatgctttcccaacaaaggaactctatctcggagcagactgatacatcatttcaatgggagattttaatcaatccttttgttttcccttttaggatatatttaaatttgcaagaacttctcctgtcccaagacaaaagaggtccattgtggtatctcccattttaattccagagaatcagagacagcctttcccaagagatgttggcaaggtaagtcagacaaacagcaaatgacaaaaacatgtttttatgaaaagatgagcacagcagactgagtatgactgtcttggtgaccagctggaattagtcttcatctgtctatgataagagaccaaatggtttagtcatgaaaagaatgttggaagatcattcatatgcaaaagaggaaattggaaaaaaccaatagcagctttgaatattacgggatcaacatggtagatgatgttgaaattaagcaggaagatgtcaatggttaagaaacaaggctcattgcttttatagattatattcaggtgatcaccagatagggccccctaggatggtagtatgttgacatgtggccttcactgagatcctgtttttcaaatatttaggtctacgcgtaccactgggtcggttttccaaaaactaaaccagatcaagggaataaaatcatactaatcatatccagaatcggatatggaaaacactgtcccatgaatcagaacaatagcttttccaggaagaaatagtcactgttaaatgtgccaaaatacggatactgcctcatcagtacattctcccctctttaagagagtcaacatggagaatcaaattttgagcagtttgtactttttggttgttagaaacaagtgctcagtgccgcaaaggagaaccagcactcaggaaaagagttttctcagcaaggcaatttacttctgcggaagggtgctgcttgtacttctggccactgggagagcacaccaaacaaaagagggaaggggtttttatccctcacgtggttagtccctgcttctgtgtcctgtccccattggctggagttggattgcacaatctaagctgacctgattggctactgtttaaaattgaatatggctaattaggcaggaagggagaggctgtctgttatggtacaaggcatgtttgggcatgtcagggcacggcaaaggcgggaagggtagtttcattgggaagagctgttttggctggaggggcagtttacagaatgggtagccaggattaaagaggactctttccaaataagaaagagatgtgagtcacagattgggactaatgggagaagttgtttatagagcaggtagcttaggagaagggacaaggaagttgatctcgagaacaaagaacaagggagtcagaaattaaacgtttgaaaaggaacttactgtatcagacattggtgagcctggaattcgaaaaatggtggttggttaaatgaatgatcttaatggcagttgctgttgaactactaattcattaaatacacagtacatgtgatatgctggactccaagctttggactgggtgtgaagaagcagataataaagctaacatgctagtgggaagacagaaacaagaacattgcagagtatgacaaatgctgtgaaaatcagcaatgggatgatgtgaaaaaaagagcaaatggcaggatgaaggagtagagggaggagggaatcttcacgcagatggctgtgatggctggttggaggtactgatatttgaggggagactggaagggtgagaaaggaacagttacaggtatatctggttgaacagcatctttggcagaggtgagtctacattgcaaaggcctgaagatgggaaagaatagcatgtagtagagtcgcaacatgcctgggttgcatgagagtaagcaaggatgacagtggtaaaagtgaaatcagagaggccagcctgcccttggatgaggagttggggtttcatcgtgcatgcagcaggggaccactggaagatttccccagaagactgcatgttttgaaagatcatcctggctgccttgtagagaatgattagtggtagcagagcagtagagaggagtggaagcaaagagacccactaagaggggagtttggtggtgatctgaacaaaggtgacttggactattgaaaattgatcttggacgggcatggtggttcacgcctgtaatcccagcactgtgggacgctgaggcgggaggatcacccgaggtcaggagttcaagaccatcctggccaacgtggcgaaaccccgtctcaactaaaaatacaaaaattagccagtgtcatggcacgcctgtaatcccagctacttgggaagctgaggcaagagaaccacttgaacccaggaggtggaggttgcagtgagccgggatcatgccagtgtactccagcatgggcgacagggtgagactctgtgtcaaacaaacacacaaacaaaaaatcgatctttattgcaaattgaaagaagtgctaatccaatatcctggtaatcattatatttatcattttaaactcccactgtgccaaagatacctttctctaagcaaaaatctttttaagagtctgggacatgatacaaagggaagcagagctgctctaaagggatagccctgtccccttgggcagccctagccactgtgatgatccttttctagacaggtttcctgggagcccaagatgccagatgccaagggacctgactccccacttcttcaaaactcttcccaaacagtttctgagactcaagatgcattctcgtttttcagttttcttttagataatcctgggcttctcagctctcaccatgcatcagaatcagcagagacacttaaaatgcagatgtcagggctccaccctcagagattgattccactggggtgggggtgaggaccatgcatcaatatatgttaaaatatccgaggtgattcagatatgcagccgaggtggaggactgccggtcttaagcagtcctccaagagtggttgtggaccagctacattagcatcgcctgggagcttgctagaaatgcatattttcatgtcccaccccaaaaccactgagccaaaaactctggggttaaagccaggaatctgcgtttttacacagcttctaggtgattgtgatgcacactcaaatttacagagggctgacctgaaatgcactttctcctcctgtccaccactagtacacaatactttcagttgcaattccattaattaggttataataaggacaatcacatttcagttgcctggaaaatcccagtttacacctgtcgtccaaatctgtcatgtccagatttagacaataaattatgtagccatcctatagttttcttcaattacacacaatttcctccggggtatatttgggtgaattttctcacaagcctcttttcttgagctattcaatgggtccataagcatgcagctaattgggaacattcttctgcattgtttttttacttattacagcttcaaaaagcaatttggtttgcaagctgaggactcacttcttcttagccccttatgtgttgcccatacttgttctcaacttagattctctacaaagcaactgcttttctaagtgtggtaggctactaactagacaatgcgcaagagccttcaaaacctctagatgttttttgtagaattactgcactgctttgcaaaaactatttatttgtccctgctttttatgcctttgaaggtacgtattttcctttttgttcctgcttgtttctatttatctgtcttactctttatatctcctgtcttatcctcatcaactccaccacagctgacgagctgtgctctgcagagctgtggaagaggacgtaggtgttttcagtgagtgctggggaggcagggagaagggaaggaagaccacagaggcagagctctggcctccaaacaccaccacgctcccaaaaaatgtctaagtcaggacacctctaattttataaatattacgtattagacttcgatatagaatgccatttgaagaagagattctgcagctctaaaagtataaagacgtttgtctttggcttcccctagaagtggaccgcaagacaagaattcaaatgaaggcagttcatttcagaggtggaggaaatatttgtaataaagtaagggagagacgtggagaagggaaggcagctaggagagaagcttgtttatgaagccagctacccctgtgggtgactggattgtaatgtcaggggctaactttaacatggtgtggaacacactgtcagcgttacaccacccccaggggatggcactgggatactttgacaccagctggggtatttctactcccagcagtcactggtggagggccgcttccaggggtgtaaattccctggcatatctggtctgccctgcactctgtgcactgacgcgacagcctgctgaggtttggaggagaaccttagacaaaaaggattctgtacagcagccaccagtctgctggtctgcactgaaaagctgacacatagaggatgtggacagggcactgatcccttctgcttcatcaccaaaactaatatatctatattattttttgcatacttcatttcatcctctgcttttacctcatttcctgaactagcattctcatgtcctgggcttttgaaaccccctgtacttgcctctctctctccattaataagtagttcctgcatcccaggagggaaaacctctgaaattcaacctaattcatatcaacaagcatatattcagcatctgtttttataaggaactgtgctaggggctgggaatttaatggaggagaaaacagacagaatcattgatcttgcgggattacaaaagaggtgacaatatcagcacatagtcattatttgtccagcactgtgctaagcacttttcatctattatgttgaattcttatgataacaaccacatgaggatcattttccagcatgccaatgaaggtaatgagactcaggggtgacgtaacctgtccaaagccacacagctagttcataacagagccaagctttgttactgctttttgagatttcaaagtctgtgctcttaaccagtatcctcaggaaatactaagcccaatctgagaatactcttccgtggaatgaaatatcttcactgacaatttctctttttaaaacagcattaaaattgagtgcaattcttggcaatgcactcaaaaataaggtggacagagggttggatcaatagatcgatatctgatatgtgataaaggaagtatattaaaatgttagtggtagaatataagttggtgaacatatgggtacttgctgtacaattctttcgagttttctctgcatttggaagttttgtaataaaatgttgggaaaaattaagtttaactaaatataaaattatcataaaagacacaggagttagcatgctggcacaaaaacgccttttaaatcatttgtcttgcatttcaagagggtgaatggagacaaagtacgtaactggttcttgatttttttggtcatattttattacaacctgaattcctgtaaagaaaggagactcatatcctgaagaatgaagacatcaaaagcaaggtgctgtggcaagttagcccttggtggagggtttttcacaactggatatcctgctgtgtagaactgaatacccacagcagggttattcaggcagctccagggatgagagaaagtgtcttgactgatacataatttatctgtctgccaagtaattagttggttggtaagtagctaaactactagaatttgggatctgcttttccgtaatacgagggaatcatattacaaccctgagattccaaatcactgctactcacttagatagcaggtggggagtataagggggtgtatgacccccccccccccccccccgcccacagacacacacaggagacaacccgagagatcactgccagccctgggaaaatgagtttgcctcctaatttctggctcttttccatggtgcattctgccctagactatctgtcatagttttggaagacaaggtaaaacacccagtcgtgaacatacttgctcatacctgtgattttctttccatttttgaactctagacagcagggaggagctgacagtgagtgctctggagaggaacatgcagatcccaaagtggctttttcccctcccccttcaaagtatgactatttcaaaatttgggccataaataatttctcagttttaccaactttcactgataactaattgattgcatctttaaagatttttgagttcttgggcccgattgattgagagcaggggactttaaatctgtaagccagcagggaggtctttgggagatgtattttattctgttttatattaagtttgaaagacaagtcatttatgaaatgcttattagagattctgctttcatcacaaacccttttcatcaaaaccaatgaaagtacttttttacagaaaatcctgttttaaagaccctataaattggtagaatgggcatttagaaggccatctttaacccaggatagaagaaatatgtaactgggccaagtgctgtttgtaaagggaatcaacattgatcattagactaaatcatgaaaaccactcaaccaggactccgctttgattgtgtcatgaacgtaagtcagacatgacggtaatttacatcagctttgccatgttcctcagtgttctgtgcatctgattcttagaggtctcactgcatccagatactctgtacctgagatttatgcccacctatgcgaataggtgccaaggagtctgatagtcttggaatttaatttgttttattctatttaatagccatttgcctcactttgaagacccacgaagaccaagctatatccttagaggctgaaccagaaagctggtactgaagccccagcacctctccatcacccctctcctgaaatgcagactcagggttacttgctgttgcctgattgattttatgatcaggcacttactgggttgtctagggtaacccagtaattgctgtcatccctctacctcttttaaaatctattgttttgtgccctttatctatgtctaactatatacacttttctcagaaatttacatctgcttaatttctaccccccacccaccccccaacacccccccctttttttttttttgagacagagtctttctctgtcaccaggctggagtgcattggtgcaatctctgctcactgcaacgtccgcctcccagcttcaagcaattctcctgctcagcctccctaactgggactacaggtggatgccaccacgcccagctaatttttgtatttttttagtagagacagggtttcaccatgttggccagactcatctggatccatctgcctcggcctcccaaagggtggggattacaagcatgagcacctggccttaatttcccccttttaaggcaactagcagttttattcaataactgaaacttaccataggctagagtataggagaaaaattggaatacagagtatctaagatgcctaaaggctcagtgctcaaaaattcttcttgagatgaacatcacagtttatttctacattcagcagccatagctacacataagcctttcctatttccaagtctttgaactgtcagttcttcctgggatacaccctctgtatccttattccttaggagcagcccacattcacactctaaggctgcactgtcccatggaacattgacattattgcaggaagttctgcctctacacagcccaatatggtacccactaaccacatgtggtcaatgcagttataaagtctttactaattttaattggggctcaaaaagtaacacttcattccattattgggacaacttggcagttgaatgtacctttttcctgatacattttaatctatttacagataaaatattttttactgaaaacgcaatgtccacactgagatgttttgtaagcgtaaaatacacattggatttcaaaagcttatcacacgaacacaaaaagaatggaaaatgtctccttaataatctttgtattgatttcatttggaaacaaatcccttgtatttcttttcactttttttttaacgtggctgccagaaaagtattaaattattaatatggctcacgtatttttatcagatggtgctaatgtaaataaggcctatttttgatacagtctctcctcagtggaattatgtttttgagacagagtcttgctctgtcacccacactggaatgcagtggcgtgatctgtgctcactgcaacctctgcctccggggttcaagagattctcatgcctcagcctccctaatagctgagattacaggtatgcaccaccatgcctggccaacttttgtatttttggtagagatgggggttcaccatattggtcaggctggtctcaaactcctggcctcaagtgatccacctgcctcggctgcccaaagtgctgggattacaggtgtgacccactgagcccggcccatggaattttacttgatctcttttatacattgtttatacatctttgatggcacttaacacattttgagagacaatgtccttccctgccttcccactaactgtaattcatcagatgcggtggcccaggacagggcctaacacagagtagcgactcaaatattctctgaattgaattctagccatatgtatggctgattaacatagacattcactgcttactgattaattaaagtgatcatagcctgctttgttgttagaatggaattaatagaccattatatgatcagtctggatatttccagcaaattttaattttctaaattggtaatgaggccaccagataaattgcttggcagtcaactattatgtcaggtcatataagcattcttagtagatttgttttttttctttgagacagagtctcgctctgtcgcccgggctggagtgcagtggcacaatcttggctcactgcaacctctgcctcccaggttcaagcagttctgcctcagcttcccaagtaactgggattacaggcgcccgccaccatgcccagttaatttttgtatttttaggagagatgagctttcaccatgttagccaggctgctctggaactcctgacctcaggtgatccacctgcctcggcctcccaaagtgctgggattacaggcatgagatgctgtgcccagccagtagatcttgatagatttgatgttgatggattttatgtggggatggggtggggggagagagagagagagagagagagagagagagagagagagagagagagagtgagttacatgactgtatttctgaatttgcctatgtatatgatggtgttttaattccaattaaatgaaaacactcataacttttatcttttttcacaactgaacacagtcaattctaacttatttttgctaagtctaataaaagctatgttcaccattcgcaagtgttgccctcctgcaaattttaattaatgacaaaacataatcgggtggttttggctttttgccaaatacatatatatgcaaaacttccctccatgatctacatcccgcaaataaaggcatctgagcccaaggaggaagcaatatttttaaccctgagtttatcaccctttcggttctccattttaaaggttcctagaactttattgttattatgaacatctggcctcagactgaatttatatttaattatttgtgaacattcaaggaccaggcatttcagcttgaattagcatccagactcagggttgttgaagaattttcaaattggactagaatgttcactacctaatgaatgtctggatctaagccaaacatggctaaccctactgtcctgcttagtttttacaacagccctataaagtaggcaatcctacactcatttctcagatgagaaagtggaaattaagagagattaagtaacttgcccagggtaaccctcttaaagaacggcaatgctgagacccaaaaccaagactcttcaatgccacatcagtgatctgtccaccacaacgtgtgtgaatgcttaaagcttccatgggtctttgctgtttgcatagcacactcacacaaatggtcatttgactctcataagtaccctcagaaatcaatattatgtccccattgtacagtggaggctctgaactgagcatgaccaaggtgcagaagcatcttgcaaaacagtctatttgtggtacaaactgagttgcctttctgtgtcacctgcaattgtaccagggctctggatggattttaaaatagcacatggcatgagttaagccactatggaaaacagtgtggagattcctgaaagaactaaaactagaactaccatttgatccagcaatcccactactgggtatctacccagaggaaaagaagtcattatatgaaaaagatacttgcacacacacgtttatagcagcacaactcacaattgcaaaatcatgtaaccaaatgcccatcaatccacaagtggataaagaaactgtgacatatgtatatatgatggaatactactcagccatccaaaggaatgaattaatggcatttgcagcaacctggatgagattggagactattattctaagtgaagtaactcaggaatggaaaaccaaacatcatatgtccccactgacatgtgggagctaagctatgaggacgcaaaagcataggcatgatacaacggactttggggactgggaggaaaggatgggagaggggagagggataaaagactgtaaacaggatgccgtgtattctgatcgggtgatgggtgcaccaaaatctcacatatcaccactaaagaacttattcatgtaaccaaacaccacctgtaccccaacaacctatagaaattaaaaaaaaaaaaaaagaaatagactttgtctgggcacggtggctcatgcctgtaatcccagcactttgggaggccgaggcaggcggatcatgaggtcaggagatcgagaccatcctggctaacatggtgaaaccctgtctctactaaaaaatacaacaaaaattagccgggcgtagtggtgtgcgcctgtagtcccagctactcgggaggctgaggcaggagaatggcgtgaacccaggaggcagagtttgtagtgagccgagatcgctccactgcactccagcctgggcgacagagcgggactctgtctccaaaaaaaaaaaaaaaaaaaaagaaatagacttcactagaggaaggagaaacatacaagccaggggtgagccaaggatgagaagcatagctcaccatccccctcattccacagggaggtctgccaggggagaaactgggctctcatagctgttccttctctgccggacagcttcagtacaatcttgttagtggacagacgatcaaacaccagggatgttccgcagcctgaatgcagacagcttcagtacaatcttgttagtgggtagatgatcaaacaccagggatgttccgcagcctgaatgcaggttcccagattcgtaggagtggtctgagattccaaagttcaaagtcagatgctttgggtagggatgtgctggaaaactggctctcggaggctggaagccttgagttggagtgtttgcagctactttggcataaattctcccacagcggccagtttcaagctagcagcttacaaaatctctgaatgtttaacaatggacttccatgaaggagtagggttgacttcagcacggcactggccttgggactcagggaccgtgacactggaaggggtcagggggcacatgggtcccaggggagctacgcttgagtgaagccctccattgtggagaagtggcttccacacccacctgttcaccccgggttgcagctggtctcatgcccagtttagcagtgaggatcattttttgacaactctgcctgttgcaggtgttaagtaacttgtccaacttcatgcagcaagtgcaacataaaagcaaagctccaccactcttctccttggcacagaaaaatccaagtcactctcctaaggctggaaaattctgcagcaattgtcccagttctacctggaaaatgaggaagggagtgataaaattctctgtgaagtgaggagaaatgaggttaacctcgccaacatttatttgatgtgcgtgtttgtgcgctgagtcagggccggaggtcgtgtcttcgtttaacaaatagaccacatgttgacaagcaaaaaacggctttctttgtctggcaagaaaagccactgcctcgcttcagacaacgcttttttttgttggtgtctccgctgacaaccctgttcaaagagagccacaaggaatgaaagtgaaagcagaaaaagccaacttcggtgtaattaagagatatcactgcccgtttttctcagtgatgaggccgcagctgactcagtcgataagggccgtgaaggagtggggcccagggcgcagtggggatggactggccttttcacggtccaattactggtccaattactagtccaagttttgaagaggattgaagtagaactggatggagatgggaaagagaccaataaagtgttttttgttttttaggttttttttttaagaggggaggaatgaatgaagaacttcttttattttcttttccggcttggagctagctctggttcccaaatagggtcctgggggaaagacgtgatgtgagtctgggtggctgggaacagtccctcctgggtatctgcgcttggcccacttctgcaaccagtaatggaggagacagaagaacgcttgaatgtgggtttaattgttcccatctgtgagtgttgcattaaagatgttgctgtcttctgttgcatcgggtggtttgggacaagtgatgaagaaagagagtcagttgatgcctcttgagcaggcatacactctccctaggctgaaaattgagctgcattaattcagaaatatttactgagcaactactatgtgtcaagcactgcactggctactgcttatggattcccccgagaagaatgcccgtcctaggagagggggcagacctgtaaacaggcagacaagcgctgtgatggggtgctgtgggatcttggaaaaatcgagaaggcagaagaagtaattccgaagaggactcctgaaggacgcctaagagcaggcaacgcgaagctgagatgggaagaaagcgctctccaggcagtgggaagaacatgatccagtatctacgggcgagagggacggtggtctgtccagagaggtgagaataattcaaagtggctgtgatgcaaggaggaaattgtcacaaataaacttggagaaatcatcaaaggctggaagaggaaaaattgtaaaaactactgtatggaatttggacctttttctacggatgactaagtgttatacattggggaatcacacgatcagatttgcatttcaggaagtttagtcctgttacgctgggtaacacctgaaggctgagaaaaccaggagcaggggtgacaaagagggaggctgtgacagaaatccaggagggtgacgaagggctcccgggcaggggagaggcagaaggactggaaagagggcacagtgaagggccatggtgggggataccaggcaacactggcaagcaagtggacagtgatgagtgaggaggtagaggaaggtcccctcttagctgggacattatgcctctataggacgctgaacaaagtaacctgcggaggtgttactttgtgggaatgtagactgtgaaactgaaggaactgttttatccacctccccgtagtttgctctgtgctgaggctgctgtactgctcctctttgaaataaaagagaactcttcccagaggtgacagatccacctgcgtgctgtatgttgcatggaggtgggcgaacaggttatgtggagggttgttcttggaaagacggattcattttgcaccagtgacaggcttgagggaacaccagcgtgtcacacgtctcttcccagtgtccctgactcatccatgcctagggattttactttagtccttccttgctgtgaatttgaaaacttttattttatttttttctactagctaagaaatgtgtaacagctgtgttcactgttggccttctagcctcaaatttattttaaatacatttcttcttagtgatctcttctttgaatgctgatgttggctatgcattagtttacacaattcacaggctctgtgttgctcaatttttagttcatttatttgacaacttgaaattcatcacaagtggtgcttttattttgttatttgcatctggaaatcattcctaacatgccatgaaatacatctgttttttccttttgcaaatcacttttttttcttattataagagtaatatgtgtttattgtagaaattttagagaaaaatacacattgaaaaataataatataaaaatatccggccaggcgcagtggttcatgcctgtaatcccagcactttgggaggccgaccgggtggatcacctgaggtcgggagtttgagaccaccctgaccaacatggagaaaccccatctctactaaaaatacaaaattagttaggcatggtggtgcatgcctgtaagcccagctactctggaggctgaggcaggagaattgcttgaacccaggaggcagaagttgtggtgagccaagatcataccattacactccagcctgggcaacaagagcaaaactccatctataaataaataaatatccctgagtcccaccattggggataaccgctgtagacatccgagggttttacctctctatttttaaagtgcgtatacattcataaagacacagcatcaggctgtaccaccagaggtttagatcccataggtctggggtgacacctaacagttaacattccaacaagcctcctggcactgctgacaagcccagctccatggccggcccacactttgaggagctccacttctaatcatacctattcctacacatgaccatcttgtgctcatgcattttccacttgccaatgtctcagaaaccttcttcatgtccttcatcaacacgtggtatggcagaccattgctatggccaacactgagtttcagggcttctaatgtgggatctactgcctctgcagggacccacagataggtctgttcactttctcatctgatgtatcttttttcttttttttgagatggagtcgtgctcttcttgcccaggctggagtgcagtggtgtgatcttggctcactacaacctcgctgtctcaggttcaagtgattttcctgcctcagcccccagggtagctgggattacaggcgcctgccaccatgccctggctaatttttgtacttttagtagagaaggggttttgccatgttggccaggcttgtctcgaactcctgacctcaggtgatccacccgcctgggcctccaaaagtgctgggattacaggtgcgagccgctgcacccggccgatctgatgtatcttaaggcatagagcatgacataaaatgactgaagagcacctcacgatttttgtttcttacccttgtttctccctcctgggaacggactgacccaaggtttaaggcaccaagaatgcccagcaatgtatttttttcccagataaaggaagatctgccacatgaaaaatgaccagttatcttggtctattgatgcacaattgctaaacagacaattttcacatccattctcatttgaagttcccaatgaaccagagtcactgaagtatccactatttcccttcctgttgcagaggaatccaccttgaagctatgaatacttttttgttgtatttatatttatcaacacttatatcttctccctctcctgattcagtgagatcagagaatattaaagccggaggggctctggaggtggcctgctccaaatacctcacttgatagataagacacaaaatgatttttctgggatcacaagatgggaacagtccttaataaatctctactccctcactctggtgcccttttgcctacacccagtattctgagccttcattgtcctaggaatggctgccctgagcctggggatgtcccagggtttttaggagcctcagcataagcttgacataattgatgtcagcatgttcacaatctctataggatcatttctactgagactaatcttattctttatattttcatttctcttcgcagtgttcttagaggttgattttttgtttgtttgtttgtttttactttaagttctgggatacatgtgcagaatgtgcaggtttgttacataggtatacatgtgccatggtggcttgctgcacctatcaacccatcatctacgttttaagccccgtgtgcattaggtatttgtcctaatgctctctctccttttgtccccaacccccaacaggccccagtgtgtgatgttcccctccctgtgtccatgtgttctcattgttcagctcccacttacaagtgagaatatgcggcatttggttttctgttctgtcttagtttgctgagaatgatggcttccagctttatccatgtccctgcaaaggacatgaattcattcttttttatggctgcatagtattccatgtgcatatgtgctttcactttaggagctcaactagcaactcccccatgcactccctcctccagtgtcagagcacactgcaggacccacccagtctttgaataggaaagcactggctgaaaagccccagaaagtggggatgtaccagtacaagtttcccacctgtgtatcccactgttttgtttggggagaacaacggatataaccgaaacgggctatctggtgagcataagttctacattaagttgtccctgtgcctgaaccatttttgtttgtttgtttttgtttttttttttttttttttgaaatggagtctcatcctatcacccagctaaagtgcagtggtgtaatctcagctcaccacagcctccgccttctgggttccagccattctcctgtctcagcctcctgagtggctggaactacaggtgtgtgcccccacacctggctaagttttttattttttagcagaggtggggttttgccatgttggccaggctggtctcgaatttctgtcctcaggacccacctgggcctcccaaagtgcttagatgacaggtgtgagccacagtgcctggttgccttgggccattcttcatccagctgcctcctactcatcccttgggtctgaggttgaacgttacctcctcggggaagctttcctcaattccccaaactgaatcaggtccttcctcatgtgtagccgttcgcctagtccttctccagagcactgatcacaccagtgattaattaagtatttgttcaattgattatgcagcaaaccccaagatagcagaatctcagtttttcttatttacccttttatcttcagcatctaggatatgtctggtggactaggctctcaataaatattttttgactgaatgaatggtcaaaaaaggccaactccagtggtctctctacaaggtgataaaagagtaaaggggccgggcgcagtggcttatacctggaatcccagccctttgggaggccgaggcgggcagatcacctgaggttgggagttcaaagaccagcctgacccacatgaagaaaccccgtatgtactgaaaatacaaaattagctgggtgtgatggcacatgcctgtcatcccagctactcaggaaggctgaggcaggaaaatcgcttgaacccgggaggcggaggttgccataagccaagatcgtgccgttgcgctccagcctgggcaacaagagtgaaactccacctcaaaaaataaaaaagagttaagggcaggctgtcttggacacatctctacccctatcttacatgcagaacgaatggtattaattttgtgatgaataaaaaatattttttctttggatatattttaaacttggatatagttcacatattataaaattgagtatatttgatccaatatgtcaagtaccattaaatggataaaatgataaatttggtagaagaaaaaatatttaggaaagtctcagaaatttaaatgtaataaatgaatatgtattcatatacatactataaaactcattatgtaacatattacataaagcacattttgtgttgaggagtgagttccctgtatttagcttcatggaaaaaatagtttcttgtagataaatattacaggtgactgaactaaaaatattttgacaatgtgaactacttggatagcaatattttgagttgttttatacactagttccttatcttaaacagaagttaacatactcatttatcaatggagaggtggcatttatcattaggaccatcaaaacaattgtgttaaaatctcagggacaagaatgagtgcagggattgtaagctcctctgctgggtgcttcgttctgctcttctatacaacctgctctgcatcctcttgagtgctttttaaacttccctcgtctcctccttcgtttccaggctttctcacccactactcctctttgccgttcctctgcctgactctattaagataaactaatccttggaatttgctgctttgaagttgatgtcggctgggaaactcatacacaggcgtgtcccagtcctgtggtctagaatcaacatagtgagacgagacagaaggctggtggttgctgctctgctggttaccagctgtttaaccctcggataggtcacactgaaaacccctgggccctgtttgttcttgtatgagataaggctagtaacactcacattccacgtttggggaaggataaaatgaaatcgcctgattggtcatacttgacccacagctagtgcttggtcaacgtgccccttccttctttctctccctacctggagagcctacagatgtggtaagtgattctgaaggtttctcccatgaggaagtgacacaggcttgtacttatttggatagtcaaggcaccttttgttcctgcggttgacactcttccaaatagttgaagttacgtgtaagtgaacaccacctaaccaatatgctactgtatttataaaggatgctaacttgaattagctttgcccaagcagaatattttaaaaaataaaaataaataagaagcagtagtccattctacctgtctgccaatttctatgttctagttaaggacatgggaacacatgatcagcaatacatgatcagatataatcaccacgagacaaggtgtgttaacaactttacgttcagggcctggaacataatagatgcactgtattttttgactaaataaatagctattcctggaggtgtgatgattatactatgcccagatcctgccaaaggcaaaaaggcaaaaagttatattcagaccagctatctctctatttttttccctgctcagggctaaatttttccgaaaaaatcacataagagtccaactgtcagaatgagttcatcacctgggctggggatcccagattctgtgagcagaagacttcatccacccaggtgtctatttcaagaacagtctcctcttttgcaaaagcgttcatggaaatggccttctctcctaacagacagcagctacagagcctcctttccctgggctgcagagggtaggttaatggagactgaggagccctctggagaacagcaaaaggaacacgatttcacccttcttagcatcctggggcttgtgatacagatggcccatgttgcaaatggagacgccgtggctatgttgccacttgcccttgcagacacaagtacggggacattatattcaattttgggtctccatccatatgctgctcctccaatttatttgtctacatgaagggatatgaagcccaaagccagaggacatccaattcggctttaattacagtgatgagctgtttgtcagggtgccatgagctgcaacgccaccttggtcgctgacaaactcggagcaggggtgacaccaactcccctgttggctgctgatcattgaggcttgggcagcagcagcacttagttcaatatttgttgtttgaaacccaacagttatgactctgccaagcttaatgaaagggagaaaataattatcagagagcttatgcaattttgaagaccaggggcttttaaacaaagttaccatgccagaagtgttcttggcatgtcatgaggactgttgccgttattagcgatgacaatgcagtcattatttttacactggcttaattgttcagcagacaccaaggaccgtgtcaacacagttctgcaaatggaaacaaacacgccatcattcagggtcccactttgatattctgcctttgcacttgtttcattttttctttgaagaacattctatagatcgaaggaattattccagacctctgattcatgctaggcttattctcttcctcattcagtctctcaatcaatcaatacttactgagtacttgtcattgcaagacctgaggaatagaggggctagcagaccagcctgggttctgcccttattggaatctttcaccttctactgcagaaggtcccacctttaggtagaatgatcagagatctctctgaggatgtcacatttaaactgtgactctaaggatgaaaagaagccagatttgtaactaatgaaaggatgttccagccggatgctggaactttgggaggccgaggcgggtggattacctgaggtcgggagttcgggaccaacctggccaacttggtgaaaccccatctctgctaaaaacacaaaaaattagccagacatggtggcagcacctgtaattccagctactcagaaggctggggcaggagaatcgcttgaacctgggaggcagaagttacagtgagccaagattgtgccactgcactccagcctgggcgacagagcaagactctgtctcaaaaaaaaaaaaaaaaagaaaagaaaaggaaggagggaaggaaggcaggaagaaaggaaagaagaatggacatttcaggtggagggatagcaactgcagaggccctggtagttgaagacattatgtctagataactccatcaccatggcttatgccatgtaggggtttgtctgtctcacatagcaagaaacctaaaagtaggcaaaagtttaccagtgcagccatgtcaggaccagcatctctgcaatttgtttggtcttcccttatggttacaagctgcctgcagcagctcaggccatcctatctaaggctggggcaggagtaacaggaaggttttaagctaactatatctgtcattttttgtttgttctatttcaagaaagcaagatattttccagaaactttgagcagttatatgtgtatgtcacgttaaccagaatggtattcaacaggcatccctaactgcagcagcagctggagaagtaagatttagttgcaaataccaataattcaagcacaattggagtttggttatcaaaggacaaaataggccatagatatttcaaaaaaaatggtatgttcaaagtattattttaaaaaggccagggatggggccaagcatggtggctcacgcctgtaattccagcagtttggaaggccaaggcagacagattccttgaggtcaggagttcgaagttagcctagtcaacatggtgaaaccctgtctctactaaaaatacaaaaattagcctggtgtggtggcacacacttgtaatctcagctacccagcaggctgaggcaggaaaattgcttgaactcaagaggtggaggctacagtgagatgagatcacgccgctgtactctggcctgggcaacagagtgagactccatcttaaaaaaaaagcccatggaggctgcactccaaaggtggagcgatagcatagtgtaacatgatttttgagatgtgtgaagaggtcaaatccacagaaactgagggccgtgatcagacatcaccaactgtagtcaaccacatgttaaagttgaattgttccgtcttctgttttccacatccaccttcttccgtccaccctttcctgaaggtccgtgtgaggcctgaccttgctttgattcttgcagtcctcttctaactgtgcccctttgcctccacttcctgcctgcacccttgcatctcctatctgtgacttttaaagaaagtaaatctcaacattcctcagggctccctatgacgtaaattccaagcttctctgtgtgacctcaagtcatttctgatctggtgccttatcctgcagccacagcccctgccacttcctcctttcacgactatcttatcacagctgtcctgttatttgtgattctcccaacatccctcaggaacatttgccttccttgaagtcctttttcttcgggtcctttccagagtcagagtgggcttttcttgacatccttatgggaaagggacaactcattcctttgcctttccaccccacttgcgttccacccctaggttgctacacattcccctagagggcttttgtttgtccacctgagtatcttcttcccactggtctctggggtcacagggggcaaagacctcacctcactcatcttggtctctggctctgagcacagcaccctgacaccatcataagctgtaactacaaattcaatggaattagtatgaaggtaaggagccagcaggttctggtggctcactgaggcattactgttcttgtttttgagatggagtctcactctgttgcccaggctggagtacagtggtacgatgtttgcttaatgcaacctcagcctcctaggtacaagcaattgattctcctgcctcagcctcctgagtagctgggattacaggcgtgcgccaccacgcctggctaatttttgtatttttagtaggcacggggtttcaccattttggccaggctgatcctgaactcctgacctcaagtgatccacccgcctcagcttcccaaagtgctgggattacagatgtgagccactgtgcccagtttgaggcattgctgtttaaggggccagagagaccacaataggcacagaggctgagacaacatgggtggtaccatgtagacaacatgtagacaacatgggtaccatgtagacaacatgtagacaacatgggtggtgccatgtaggctcatccctccatgatttgctggaagaactaagacggcagtaggagaagtggataaaataatgtctgtggagtcagactgcaagggttcaaatcccagccctgccattcaccagccagatgaccttggtcaatgtacgtaatgcctctgtgcctcattttatgcacctgcacagtggaggtaataatagtgcctgcctcataggattttccagaggattgaataagataatctttgagagtattccagtacatggtaaactctcgcaccatattaactattgcagtatggtgttattattattatgaatatctaatacagttaatatctttgtacgtaggagttttagcaggcaggtgtgaatggcacttttgaagatgcagagacagatttatccttatactcctaatatttatcctcaaagacactatttaactcattcaaaaatatttactcttttttaaagaccgctttcagctcctttttatacaaaaaaaaggaattctatcctcattctagcaatagtagcctaaagaaaatcttattacactcattatcttaaattaaggtaattgaaaaccactgtttaagagtagaccccaaatgtatcataaaattaattcaattataaataacaagaattgactgtacttgaatgtgcatgaagtatagaatcatagtggaacatttaagaaatatgtccttatcttgttactatggctacatgttactccaagatacagtagttctatggtaaggttggaattacattatttcctctctatattgaaatattcagcaactaatttcctgtagcttcatagtaaatcatgctaatgacctcagaggtggaaaccaaggtggtgagactttctccctgctctaaggttattccattaaacaaagcagagaatacacatttatactcatttgatcaggaagcataaggaagcttataatgagaaagacatggcaatgacatctcatgaggcgatgttaactttaaactcaagtatttaatattatttattcattgcgtccatgataggatcacaacagtgagaaaactagagattcatatgggcaggaactgagaggggatatggtacaattgaattcaattccacaagtaattcatggaaacttatcatgtgctaggtacgtattaggtaggatacccccataccctattctttgtctactgaaattattataatatttttgtgtatatcactaaacattcaaaacagtgggaataatgaagaaaggaagttacactggtttctaaaagccctatcatcagtagcaatttctcaaaagctcttcatgacatcctagagacatcaaagcattggaagcactggggtgctggggctggctcacggcatcttgcaccagcggtacatatctcttccaaactctgtattcagcgatgtcttgttggtagttgaagtccaccatgatggtaatatttacaccacagaaacaaacaaatattacaagtcaggtctttttttcttcttcccagagaattggctattaaacagttagcagcatgccactgattacaagcagcgatgtgagattgtatcttcttatttcaaagactgctctttccactttatgtgtttgtttccctttcccaaacctcttccacattcacctgtaagactgatttttgcctctctagatgaaggtgagataagagaggtttgtaagcttgtctctgtttacttcaccctgagtcaagccaccaacttctcttgctggactttgtctgtaactttcaaattagtccctttgtgttgatgcttgctcccctccaatccaatctccatccaccaatgagagtgatcttctaaaattgtaagtcacttaagcaaacagaagaaaagtaataataatgacatccctaattctctctctctctgtctcatgtctatgtctatgcctatgcctatatctgtgtctatatctccctatccctacccacttttctctcccttgctatcattatctctgtccccaatatatgcttctgcacatctcacattctggctttttcttatgctgctccccataagacccttcacttctctattgacatcattttcaccttcaactccacactcagatactgactcatacatatgattgattctcacctgcctgtgtcttgttgatccaggtctcagcttagaaattacttcctccaggaagctgtctccaagtcctgttcagatatctgtccttatagagcgttttttatctcacttactatactttttgttgtcttacctatttactatatgcttatatagtaagcaactcttaggaattagacaaaagttcccatttctgtaagacagatttccaaaacaggacagatgcttgatgaggaatgcttgagctggatttcaaccttttcttcccaagtattttgtgtggtgaacaacctgcatgactggcccttccccttaaccatttccattatagcatacattctgtcattgtagcacttagatgtgtatagcaatctttattatctgcctctgtccctgaagattatataccccatcttttttttacattcccagtgcattgtgatcatatattattcatctttatgtgaaacatggtgacaagcatatagtaggtgtgtacattttgcttgaagtaaagtgaaatcaatcttgttcccataccactcaaccttactacctttattcacccagatactaatcaggtactgcttcattccagatgcttagaaagatgagcaaggcacggaatatccctgtaggaaactcgaaggcccatcagagagacagacacataattgaacagtggtgacacaatatgctccatgacaaacatgtgtgagactaactgcattagaattccctggcatgctttaatgaagatttccagactgtacctcacacctaatgaattaacatatttgtgctgcttcttctgtcttctctgtgcccctcttcccatcgtttccaaccaactcagccagtcactgctccctccagcagggaatatgcccctgtgaaatgtacctatgggaggatagccatcattggctagacctggaaactagttattctaacccagttaataacaaacccagaacaactgaacccctaaaaggcggtggatttggacaagaagttctagagagtatttgctaagaggtgttgatatgttgcaaagaatcaatcacttatttttcaaggatagctttaaaaaaaaataaaagcccacctacttagtctattagaaataaagtcagtaggccaggcacagtggttcacgcctgtaatcccagcactttctgaggcagaggcgagcagatcacctgaggtcaggagttcacggccagcctgaccaacatggtgaaactgtctctcctaaaaatacaaatttagctgggtgtggtggcacatgtctgtaatcccagctactcaggaggctgaggcaggagaatcacttgaacctggaaggtggaggttgcagtgagccaagatcgcgccattgcgctccagcctgggcaacaaaaaaaaaagaaaaggaaaagaaaaaaaagaaagtaaatcactaagtagccttttgcaagacaaacaaaaaaaaaaagaatatttaggatttagtctataaccattgacttttggaaatcctgtccttcctaaggaaaattagaggaaaaaaaagagctgaagtctctgttgcatgagaaataccatttgtgattaaactgctgtgaaatacatactcaaaactgtgggaaattcttgccacatctttctaaaattgctgtttgatgtcttacatgccaaaatgactgtgaactagtgctctcttgaaaaccacctaaatgatccacgacaaggaagtcattaattaaataataaggtggatgtggactactatgcaatcattaaaaatctattctcaaataatttttaaacatatagaaaaatgcataaaaatactattaagggaaaatataggttataaaacaatattatagcattgttctagttttactaaaaaatcgtgtgtattcaccaaaatgttgacagtagggtttaaaatggactggtacttaaaggtgattcctttacatttttttctacttgaaatatttctatatttatttgacttcttcataatggccatgttttatttttagggctgccattcaattggtcatccaatctgggacaggtttcagagtaaaagaggaaaccttagcaataatatgggactataggcaaaagcaggactgttttggacaaacacgctatgtggttgttacgggctgaattgcatcccccaaaacccatgtgttgaagtcctaacctctggtctctcagaatgtggctttccttggaaatagggttgtggcagatataattagttaagatggggttatactgaatgatatagattgggtctttaatccaatatgactggtgtccttagaaaaaggaaaaatacggacatagacacgcccacaaagaaagaacactgtgtgagcaggaaagcagagattgggatgatgcatctacaaggcacggaatgccaagaacagacagtaaccaccaaaagccgtaaccgcttagtgggttcaccttacctgctgcctacccagagccaacttctcaagacaggggaattgcaatagagaaaaagtaattcatgcagagccagctgtgtgggagactggagttttattattactccaatcaattcccctgagcatttggggatcagagtttttaaagacaatttggtgggaggggaggggcagtgagttggggagtgctgattggttgggtcggagatgaaatcatggggtgtcatgttcttcttgcactgagtcagttcctgagttgggggtcataagatcagatgggccagtgtctctatctgggtggtgccagttgatccatcaaatgcagagtctgcacaacacctcaaacaatgaccttaggagcagtttagggagggtcagtatcttacagcctccagctgcatgactcctaaaccataatttctaatcttgtggctaatgttagtagtctaatccccaggcaagaaagaggtttgtttcgggaaagggctgttatcacctttgttttaaactataaactaagctcctcccaaagttagttcagcctatgcccaggaatgaacagggacagtttggaggttcgaggcaagatggagtcacttaagttggactgttttcactgtctcagtcataattttgcaaaggcggtttcaatcctataagaccaacatacaacagattctcccttagagactcagaaggaaccaaccctggcattaccttgatctcagacttctaacttccaaaaccatgagacaggaaatgtctgtttaagccactcactttgtggcatttcggttttttgtggtaggcctaggaaactaatacaatggtcattgtagttattttatatttagaaattaagagcaattctggaggtgagagatgggcaggagtagggaagaatgaagttcagtgcaacaaaagaagcttgttcactcaactaagactgtaaacaatgctgtttttcaaaaatacgtattccttctttctgcctggcccctctttagagagccatgtcctgttgatatcaagcttgaccatgtgacttgcttcagcctgtggcgtgtgagtcacagtcacatgttccattgagaaatgggagctttaaagaccatgctacggttctgccacctttgtcgtttgccatgacacgagcttatcctaagggagagctgcttctttagcctgaaacagagttgaaactgatctgcaatgaacctgtcacatgagataaaaatgtatcttttggccaagtgcagtggctcacatctgtaatcccagcactttgggaggctgaggctgggggttcacaaggtcaggagatccagaccatccaggccaacatggtgaaaccctgtctctactaaaaatacaaaaaaataaaataaaattagcaaggtgtggtggcatacacctgtggtcccagctactgtggaggctgaggcaggagaattgcttgaaaccaggaggcagaggttgcagtgagccaagatcgcaccactgcactccaacctggcgacagagagactccatctcaaaaaaaaaaaaaaaaattgtatcttttactagtgttattcaccaagattaggaggccgtagtgttactgcagcagaatgtagcctaagctgactgataaaacattgactaagcaactctcaggtaccatgccaggatgaaaaaattaattagacacagaccctgccagtgaagaactaacattatactgtgtaccattggcctttaaaagataaagatttttggccccaggtgtgttctatattttctgtaagacctgcaagtaaatgttaaatgatgttatttcaaccggtttttctgtagcaaaaatctttaaaagctctcatattcaaagtggttcttgcaatcttgaactacatgtacagatataaaatctgccaattaaaattttatggtttagggaaaaaatcccctctgaaaaataaacctaggtcaattatttcattatttaattctcatttggaaaataagatgttcagacattgagttatattagaaggaagaaaaccacttctgtgggaacagtcaaatttatttcatttactattagagaatgttaatttcaagaagcaatctttgaaagcaaccaaatttggcaaagacaagtagtcttccctgagaaatattggacagcaacagattatataaggaaaggacagaggggagagacatctcaagtgtaggtctggatggaggtagaagagtcatgttctagagtcagcattgtaaagcaaaaattgcatggtgtcaaaattatccttgaaagtcccttaaatggcccttaaattgtctggacctgtgcctttagaggttgaaaggccaagaattaatgtcttttgtttctctggggcagtgaaggccaaggtctaatttgaaaggggcaaaggacgatggggaaaataaaggatctctgcctttcttggtccatcttttggtctcctgtcctctctctaggtgactcttcctccagctctcctcctgctctttcccctcaacagtgcatatagctaaagtcaaacaagttaaatgtgcatgttaggcaactctagtccttacaacttaaaaactttaaaatggatgcattgggggcctattgtgtaccctgtcctaggctagatatggaagagatataaagcagggatgggggtgagatgaggagaggaaacaacagacctcacaggagccaggaagactgaactgcaaacagatgatataaatacagtgtagtcaagtcaaggcagtagctcaggtaaacacacaatgccacaaacaggagttctcaaaccttggctgcattttagaatcacttgagcttccaaaagcttcaatgcccaagacacaccccagatgcaccccaattgccagtgaccctggaatctttggggaggacctggtcatcagcatgtctttgagctccccgggtgagtccacatgcagccaaggttgagactgggggctacagctgtgtagaagagcatctggtgtgggtctgaaggctgggcaggaattagctggtagcagtgtgcattccaggctaggggaaccccagtactaaagcttcttcagcacaaagaggcttggtttgtgctttgaacatagcgtggttataaattaaagaataaccaaactccttgagttgaatcagtacacaccataatgcatcagctcacattgacatggcaacctcttttcatctctctttgttaagggccactggttctttaaaagcatgcgtattaatggattctatctgatgatgattcactccatagttccatcatgtatgcatctctaaccagtataagcaaagcattttcctttcaagagtctaatcctagcattgtgccatatccatggccctctaagatacacaccccatctacaaaggcgacatgtactcttaaggtacaaagcatttcctttaggggagtgattgcctgtgtgtccaagctgatgaagggtgctcttttaagttggagaaaattgattttgttgtggttgttgcacaaaggtttatgttttcaaagcctccagataaaaggcaccatgggcagctaacaagcccctaataggactacatcaagttttactcacctgctgccagggcttgacttctgcgtcttgacgacatgaaaccaggctttgacagcattcatttttgctgaaggaccctcccccagcctccttccataaatcctatgctcctttattccgtattcattcagcacagatgtttttatggccataatatatttatactaattcagaggcttgccatcagtagataggctcatctctctgatccggaaggcggcagaggcactccttctgacattgcagatgaaaataaggtctgcttttttcccacagtgctcttcaaaggagcaattttctaaaattcgaacaagggtgtcatagttaataagatggaattctccttttctttttcttattatattttccaaatcaagggcagtagattccagaactccaatgacgtcaggccactgtactttcaaaatgctgttctcagtcaggtttcttattatctgatcctggttcagtagattgtctcagaattgactttttagattaattttgattcttagttaaattactttttaatagctaattaccacacagtctatctgattaacggtattgtgattcagatcaagcggtgagatgactacaggtaacagacccttgctatcatttgggtgttctcacaaggaacaggagccaggtagtgaaccatgtgcctaccctttgggcagggaatgggtggctctaagagatgacagatgctgtcatccggaatcagttctcatcttggtcaattggatgagtcagagagattttggaaacatcttcaggctaacccaatttacattatagttatattttaattgccttttaaagtctaaatgcagttgattgtgaaaactgtgtcacatcatttaagggaactagagctttctttttatggaaacgcaaaaggacctagcaggaaaataccacattgcctaagcagtaaagaaatatgtccggccgggcgcggtggttcacacctgtcatcccagcgctttgggaggccgaggcgggcagatcacaaagttaggagatttagaacatccgggctaacagggtgaaaccccgtctctactagaaatataaaaaaaaaaaaaaaaaaaaaaaaattatctgggcatggtggtgcttgcctgtagtcccagcaactcgggaggcagaggcaggagagtagcttgaacctgggaggcagaggttgcagtgagccaagatcatgccactgcattccagcctgggtgacagagtgagactctgtctcaaaaaaaaagaaagaaaaaagaaaacagaaagaaatgtgtcctcaaagcttcctcagattgttctagaaaagagcactagcagcccccaaccaatgcatgccgtgaactcattccaggtatcatgcacctttgattgtttcactttccttgggtcaaacctttagaaagtgggttccctgtctcaggcactgagctaggtaaattcaggggataagatcaggaagagtcccttcctgaatccaggtactcccactccccccggacaacaaggtcagaggcaatccctcgccttcacctctcatcttatttttaaataaaagtttctctttctttatgttcttcgctttctccttcaacaagattgtttcctgctccctccccacccctgctgcctctctgaatgttgtttctcctcactgcactgtgctgtgcagtgaatccatatttcttttccttttttccttttcacacttgaccacgtctttattcaataactctgccccttcacagcacagggcccggtggaggctgcccttccagggagcccaggctcacgtgtacttgccagggctggctgtccctgtccagcaggtcacagacctctcctggtctgacactgaggagtgaccagtgctgactcagagcagcccatctacgggcgcactgttcagaaagtcgtggaggtagatatactgctccagcgttggggtcataaggccacaggccggggactgctgcagagccacgttaaacagatccacggtacactcagtccctgcctggtgctgcagctgctccatggccaggaaggtgcccagctgggtcgcacccttgctcgagtcactgagcagtgtgcctggcttctggctcttgccctgagagcagcactggcccatggtagccaggaagggcggcggggtggtccttggtacctggagccatcaaatgctgggctctctttgggcttcttcgcagcagccttctttctttactttactcacttcctaaataacactgttctcaggaccttcattactgcatatatattaataattcacaaatctgaatttcatcctttgcctctcatttggtttccaaatttattttcactcacaattcctacatagtcagacaccttcaacttcacgtttccattttgattctttgtcttgccttccatgtcttgtagcttatctatttttttctgtctcggtaaaagttcccatttgcccacagtagaggattgaaaataatctggcttttaaaaataccctgggggaaacaaaaaaaaagaccattcatcagtctgctgattctatatctctgagtaacactgtgaattcctgtgactctagttgagttaaatttattcctagcttttaaaaataaagccaatgaaagaccagagagattattacaaagcctgcattcttgtgaagttgctgaatccacagttttattttagtcaaatcacatttccatattgcaaaaatattttctaaacaattaatgggtatcatatggggtcagtcttgtggcgtttattcttttgtaacactgagctaaagtctctatgggaaagataaataggttgttggagaattaaactggtcaagaagtgaacattgatgcctaaacctctcctctgaaattttgagcacatgttaacataggcacataaaaaagagccttagcagaaagaagaaacgatatttccattgttgggtcacagtggtcactaaaggggatataactttaatttctcatttgaacgtacatggcatccatttaaccaactcatttacagcatagccgcctgtcaagcatataaaactgtaccacattgagctggatcggtttttaaattctaatataatgcacctgggcacggtgggtcatgtctgtaatcctagcactttgggagactgaggctagtggatcacttgaggccaggagttcaagaccagcctggccaacatggcgaaaacccgtatctactaaaaatacaaaaaattagccgggcatggtggtgcatacctgtaatctcagctactcaggaggctgaggcacgagaattgcttgaacccaggaggcagaggttgcagtgagccgatatcacaccactgcattccagcccgggtgacagagcaagactctgtctcaaaaaataaagagaaaaaaaaaattgttacataatgcaccctcgcacatgctgttggatgtaccatgattcaaactatgaattctgtaggaaagctacattttaaacatgtttgggtgaaaatgatgtgtcaatgtaggttcaatgactgtatcaaatgtaccactctggtgggggtcattggtaatgagggaggctacatgtggaggcaggaggtatatgagaaatctctgtagctgactttcaattttattataaacctgaaactgctcttaaaaaaaccgtaaaaaaataagtttgatgaacttggttttcaagcaggtagcaattaagactgtggttgtcatagagacagacctatggcaatggagatgaagggtgggagcttggctttatcagaatggcaattctgcatttttgtgaatgtcagcaaatgaatttgacccatgacgtatggacgtagatcaaagggcacatttagcatactgtcaatgtggtgctcgtgtggccttccaaaaggccagttccacagtgataaccaccactaataatcctacaaacctctccagctgctttcagtgacatgacttctgatctggagggaaagaaaagaggggtgatattttataaatatcaattttcaaaaatctctgatctgttggtattaactgatgagctcagagatgctcggaaacctcctgcctgcacaacaactgtaaccatggcaacctgcatttttaaaggatgttaaagatgtttttaaacatcaggtgagaaaaacagtttccacacaagtgtttgtctgggatgttatgtctaattcctccagtacacatttttccgttactgggacttgatacaatgctggaagctttcctgttagggcagaaattgggcaacccaagacagtcacagatcttgagatcgctgccattgctatgaaaatgaggcattcttattgcatctagactgagcatcagcatgcctggtgttcttatacgtcatacatgaaagagattggcaacccttcctgaaagctttgaatttttgatatcatttgttccacgtgattttctaaggctatattggaccactatacattctagaacaaattaattaaagcctccagtttccagggagatatactaatatctcaataaagtgctggatttgagtaaaagacagagaatcatgtctgtaatcctagcactttgggaggctaagttcaatgtagtattcagaatttgaatattgagcttctatattaaagaaatcatcaaataaataaataagggtctatcagttttctgaagattcagatttttgttgtttttaaatgagtaattctaattgtattttaaatgagtatagggagggtccattttaaggagtcagaatgtaatcaaagatgcctattactattatattttcagatagaaacagataaagttcaagcagtgcaaatactaaataagcaaattaagcattatgtcttttttttatggtctgccactcatccacaaccaccagcatttgtcttgacaaaccaccaacatttccctcccccgccttgactgtgcatggatttgcatatttatagagttaaagaatcacccaccatggttctctttcttatccacattcttgtcttacccatccgtctctgtcactctcctgatatacctcttccctactaattacattaatcaacaacaaacaacaactctaaaagattccccgagatgagagtttcagaagcctgagacgctatgtcaaacaacccaccgtagttattcagggacactgcaactcaaaatgaggtagccatcgatccagagaacaaatgatcattattcatgtaactctcttctttgcttaagaatccatctttttctatcagtgccaaattctctcactactttcctggttctaattcagaagtaagtaaagtcagctagtccctttgtttgggggttaggcccattttataaagaattaaaggaaaataggttaaacatgaactgcttctcagacgtggcatttacatgcctggtgcttccttagctcatcatataaccaagtactggaatctgttttacagataataagaaacattcacgtgttccatcttttacatatgtgaggaccaggcactgactagaaaattttcatcaccattgtcctcatcatcaccatcattagcatcttgtcgtcatcattgtcacgatgacaaagatgctttcatgatgatgaaagcatcatcatgctttatttacgtgatatcattgaatccttccaacaagataccagaccattttattgtagacattttacagatatttacactgaagttcagagttgttgagtggtttacccaagaatacgtagcaagtaaatgatagagctgaaaattcaatctgtctttctctagtgctaagccttagtttccctaccaagttttaaaggttgaacaaagcaaggtgttgaaagagcaccctgagtctgacagtcagaggggaatcagggcaggaagtatctactgaagaggtcctcaaatttcaggttgcctaaacagttactgaatgagcttgtcaaaatgcataaagaaggccctacaccactaccactaccaccaccctctgacacacatacacacagattgtgattcaataggcctgagattagtccaaaatctgtatttgtggcaaactccccaggtgatttcaacagagacagtctgtaggccacccttggagaaatggtgttatagctggattggggactgttgagatgcctaaatccccaacttgtagagctagcttgggctgctcccaagtctagcacactcattgatatggtttggctgtgtccccacgtaaatctcatcttgaattgtaacccccacaattcccatgtgtcgtaggaggaacctggtgggaggtgattgaatcattgaggcaggtctttcccatgctgttcttgtgatagtgaataagcctcacaagatctgatggttatataaaaatgagaatttccctgcacaagttctcttctcttatctgccaccatgtgagacatgccattcaccttccaccatgattgtgaggcttccccagccacatggaactgtaagtccaataaacctttatttttgtaaattgcccaatctcgagtatgtctttatcagtagtgcaaaaaatggactaatacactcacctatgtagggaaacctctttgttccctacataggttctctgcattggttcagagtccatctcttccactgggatgtccatcttgtggtcaaaacctgcaccccaggtaacataaaataaaaataacaatggctataattgtgaaccgcccgctaacctcctcttgtagtgctccaggccagacgctcatcaccttgttttgttgtctttgccatcagcattatagtagagccattggcactcacccatgtccagccccgttcctcctgggcacacagaaatttccgactctgttttctattgcctttgcagtcagatggaaccatatgactagtgctagccaaagtgtgtcatctccactctctttctttccttggtaccatggatgtgtttgatatggtgccagctgcaaagtagtggaggcttcttcagtgtgggttcttgagctgtcatatagcataaagccgccacccaccattctgaattcacagcatgagcaagagataaacaaacctttgttgagttaaggctctgggattttgttttattttgttcagtttttaatttctgtaccatatcctaacccatcctaaccaataaaacctcgtcgctgtcaacatcatcatcatcatcgcaataataaaatgtattaattatgaacataaaaccttaccgtgtgctgaacattagactaagcattttgcaaacattatctaatttaataatcacaccaacactataaaaaagacatagttgttatctgtgtcttacccagctggtaactgatcgggaaaaaaatgaaaacccagcagcctgactccaaagcccgtgtgcttatccaaacactacagcgtaggttgcttagtgccagcttcagtggttagttctttacatgcttatcataggtaatcctctgtcaacctgtagaagtaggcatgattaacttaattttccattgtgaacactgaaggttggacagattcaatgtctggtctgaggccacacatcacacaccacacactacataccacacatcacacaccacacatcacataccacacaccacacaccacacatggtggagttaggtcacaatccacgtccctctgactcttgaaggaagcatcatttattgaaaaactagagtgtctaagcaggtgattttgattccttcaagtctgtttcagaaatgtctaggggccccacagatctcctgaggtcaggggttcaaaaccagcctggccaacatggtgaaaccccatctctactaaaaatacagaaattagccaggcatggtgggggcgcctgcaatcccagctactcaggaggctgaggcaagagaatcgcttgaacttgggaggcggaggttgcagtgagccgagattgtgccattgcactctaggctgggtgacaagagcgagactctgtctcaaaaaaagaaaaaaaaaatcatcgttttactgatgatatttacaataacagcttctgccagtaatagagactaccaataaccaatgctatttattaaatactaacagtgtgtatatatatatatgcatgctggctagtgtcacgccctcacaaagtggacattattatcttacagataaaaacactaatgcttggagagtttcattgtttgccacagggtgcccaggtaaaaccatggcagaactggagacaatccaggcagcctggctccaaaaccttgcagttggccagcacactctctgcccagagcccagcccacgctctgatcacagaaagtgtgtgggagatgagtagaagcaggagaaaaaaaaaaaaaaagtaaaatgtaggctaaggggttgtcctgtaagaatttaggaatccctaagaaggagaactagaggatcaagggaaaaaggccaagtccagtaagtccctccaaacgtcaagtggggacatctcagtagagtatacccctacaactgatctgccaagatgttccacaatacaaaaaggattctgttggcaaaaacaatgcccacccctgcctgtcttgaagattcaaaatgcacagtagatgatagatgatggatattctaagatttgttgtagcaagaggctggttgtgtgcttaactcttcctttctaatttgcttttgaccacagcaccctttttattatgcaaaacctattaacatctactgaaaggcactcagcatttgagggaggggactagcaggctgcagaggagggtgctaagttctgtgctgaggaaggtggttggttgtggaagatgtagtggtcacaaatgagaagagtggacagtgggtacagggtagggatgatgagacctggaattgatgacctcagcagagaaggggaggaaggataagaagcaaataacagtgacatatgtgtaagttaaaaagatggaggtagagctagtttccaagatggcttaaaaatacacatgggtgccggtttgacctcaaaatagaaattagagacctagaattcaggagagaaggcagaactagcaaatggagactctaggtcaccttacctctccttttcttggaggaatggtggaaagagaagaacaactgaaaggcttcagcacaatcgctctgtaggacccaggagagagaagagtagcctggaatcaacagtggtgggagaggctggagggcctcaggaaattcaaggcaaaagagtagttagctctaatgaccattctttaaaagtagaaaaaatgaaagtggagatgtgcattgtttgtggaaagatagaaccttcctcagtcagaaagcattttgccattagcagcaggcagtgatgctgacaatttgcagttggtggccaggttttaaacagtagtttgggcaagaaagggtatccagcaaatcaatttgcaatagctgatccctgtcattaagggagtcaattcttgatactgtaagtgaataaccaagtgctgctctggtacaattgaggtatgaaataccagacctgactattttatgtaaatctctaacatggtgtttaagcaggacagagcagcggggaggaaggggcttaagcagaaatgggctttgaggacctctcggcccagacaggaagagtaattgggctaagatgagagaggggcaaaactcagcacatctccaaagccatccaaggttgcggacaattaacctcttgattcctccctcctttccttccaagatcagatttttatcgtctcagaaacatatgaacttcaagaaaatgtgaggaacacagactttctgagccagcttccattgacatgccatttgattaatttatgtggttgggacagcagttcagagggaatatagattgtgctcttacctgccccatttccatatttaatatattcaggcatggttatgatagagcatctcatgtttacactaactttgtgtcttttgaagttcacttttaactttgtgttgataaaatactattttctaattcagatttttcaaaaaatgcccgttgggcatcaagtagcttttacagaatgaggtgttcttagcattattatgaagcaaggacaagtgtattaccgccattcacggagacatttttgcagtgttgcaaatctcccaaatgtttcaaaaaattacagcagttgcctgttgcacctcacaattagctgcctaagattctaggagagaagcagttggattttatatgtgaaaatgcctctatttgctgcatttttactttttgagaagttgcaagttacatgaaaataaacatactatataagaaaacacggcagatttctcctggtgttttaataattccacgaaggtttatgaatattggcaaacgtatttgcagtggtacttccctgctatttactttgtagactttgagtcttagattcttgtctgtaagtgaaatgtagtattaaaaaaaaaaaaaaggccgggcacagtggctcacgcctgtaatcccagaactttgggaggctgaggcaggtggatcacttgaggtcaggagtttgagaccagcctggccaacatggtgaaatcccgtctctactaaaaatacaaaaattagctgggcatgctggtgcatacctgtaatcccagttactcactaggctgaggcaggagaatctcttgaacctgggaagcggcagaagttgcagtgagctgagatcacaccattgcactccagcctgagggacagagtgagaccctttcccaaaaaaaaaaaaaaaaaaaaaagcattacaagttggagtagcctgggctcccgtgttggctttattactgagctgtgtgcaggtggatgttttgctaaatctttctatgttccacgttatcaagaccctttctctcttttcccaaagctctcgtatcaattccatttaagccaaatctcattatttcattgcttttttttttaattatcctatttttaaaattattctccctccttctggtttccattttcaaatagttcaactggatagacataatagcaaaggcatagaatcaacctaggtgcccagcagtggtggactggattgaaaaaaaacgtggtacatatgtatcatggaataccatgcagccataaaaaaataaaatcacaagctttgcagcaacatggatgcagccaggggctattatcctaagcgaattaatgcaggaacagaaaaccaaataccacatgttctcacttataagtgggacctaaacagtgaatactcacggacataaagatggcaacaatagacagtggggactactagagtggggagggaaagaggggtatgagggttgaaaaactactagatgctgtgctagctaggtgacaggaccaatgatactcaaacctcagcgccacacaatatacctaggtaacaaacctgcacttgtacccgctgaatctaaaacgaaagttgaaattataaaataaataaataaatgtggtgcttatttttaaaataaatgaacaaaaaaaccccaaagagcttagctaggtgttaagtaccatccaatggacggtgccatccattatataatatagatatttacacacacactcaaacacgcatacatgtatgtatgtgtatatatatacacacacatatatttacgactgtagccttctttccagcagaagcagtttgccaaatgcctctgcccttccttagcccaaatgctaatagtagctatttcatgaatagatacagaatgacagagtcaactttacctaacttctccaaaatgccgactccagtattccattttcaaattaacttattctgattataaaagtaatgttcagtattgttagtaaaataaattttaaaaaaaacgaacttgtaatttccccactcagagatagcttctgataacatattggtgcttttacttctatttttttctatccatatgagtataattaaatacatattcacatctatatctatactcattcatatatattcatatgtaagattaaactatatgttcaaattgtattctgctttttaaaatcacactttattttctgggaatgttctcttcataaagttcttccaaaccatgatatttaatgtccacataagaaaacatctcatggactctcaatttattgaaacttttccctagttttggttattctgtttcccaccagtcattaattactttaaacaattctgtgaggaccattcaggtacacagacgtgggtccacagttatctattttcttagcctcagtgcttggaagttgaaatttgtattgaataactaaattcctttgacaattaaaacataattatcaaacttttttgcaaagaaataacactatggtatatgacatctatggcatatgacagtccctgcttaccttatgcttgccggcattcagtgcttaggtttccttttttttttgagacggcatctcactttgtcgccaggctggagtgcagtggcgggatcttggctcactgcaacctccacctcctgggttcaagcgattctcctgtctcaccctcctgagtagctgggactacaggcgcctgccaccacacccagctattttttgtatttttagtagagacaggatttcaccatattggccaggattgtcttgatgtcttgacctcataatctgcctgcctcggcttcccgaagtgctgggagtaaggtgtgagccaccacacccggccaagctttcttaaatgggccactttgattgatgaaaatgataaggtactgtggcctttttttttgccatttaaaaaacagtggtaaggttttttttttgtttctccatgtcttgggaagcagctgcctgttcaagccctctttccttttcctatttgggtgttaatggcttccctattgattcataaaggcccactacttattgtggatattaatctcttgcctgtcatatgtttgttgcctttcttttatgccagctagttatttgaattaattggatttgatgttttgaaatactgaatttttaaatctttagacagatacaataccattttttccttatgcgtattctcttgtttatacaattaacaatcttggcctgttccaaaatcaaagtcacatgaatacatatatttttctaagtttttatggcttcatattcacatctgattcttcagtccctctagatcttactttcgatgtatggtttaatgtgaagtcccatttcaagtttttacccttcaaattaattttccttccaaatgttattttattttattttaaatacccattctttttctggttttgtcacatagctttcatgtgatgttaagctctaatacatacaacaatttactttgggaccatctcatatattaaattttgcaaaaatgccatactgttccaacactcatagttttataatgtgtcttaacacatgacaataaacccttctaaaatacacacaggtttcagaactgccttaattattttttgctttgatttttcctctagaaaaaaaatgtgatcattttctcagactcccaccctacttgttttctcaaagctactgtcacactctggatgtacaaggtcaggggtggtgagagatcagggtgtttaggagtgtttgcttgactgatggagacacagggttcccaaactggaagatgacaacataggagaagcttccagttttccagtcaaagatactatgtttcatgaggcaaagcgtgagaaactcaccaatacaatttcccccaattccactctatcagcctttgagattttccggacagctatctgtcagtcttagtacttaaaattgttggaagtttgaacacaattcttcaaagatattttagtgaggaacaagagattttgctttggaagatcctgaacagatttccttacaaaaagtatttctaagcacccatccctataatatatctaaatgttaaatgcttattgatggagtaaaatggaaagtccaagagtcgtaacattatctggtaacagtgtggatgagaggtatgggagatgtaggcatgtgcatgtttcctgatttgaccaaacttttcaacatgagtgacccttctaactagttttccaaaaatagagagaagagatccagcatcaatgaaaatgacaaaattgacaaagttttgccttggccctcttccatcgtcgctatcctcttctcctctactcaacctccccatcagtctttttacccgcccgcctccttttttttgagggaagctgtattaggccattctcacatggctataaagaaatacctgagactgggtaatttataaagagaagaggtttaattcgctcgtggttctgcaggctgtgcaggaagcatggtggcttctgcctctggggaggccttaggaaacttatagtcatggtggaaggcaaaggggaagcaggcacttcttcctggcagaacatggcagaaaaggggcatggcggaaacagggcaagagaatggggtggggaagtactacacacttttaaaggaccagatcttgtgagaactctatcatgagaacagcaccaaagggatggtcctaaaccattcatggaggatgcacccccatgatccagtcacctgccaccaggccccacctccaacatgggggattacagttgaacatgagatttgggtgaggacacagatccaaaccatatcaaaagcttttctaattaggttactcattctatgaaaatagactgcccataaataatctttgtttttcagatgaagatttggcaagttctgtgcctagcacgatggctgacatgagataagtgcacaggaaattttgaaatatctgtgtctctatcttcatttccttgtttgtgtctccaatttcctatatgccatcaggggatttagtgacactgcaaatagcatgctctttggcaggcacgcctctcccatttccccagaacctcttcgtctttctgaggcatggagtcccaagctgtatgttttcaggtagtattgtaggaagattaacagtttcctgacatctttcttgcaaaggcatgaatacctccaccggtgcagatcaacataagaaatttaatgtttaccttgccattttataatgctatcaactttctcaaaatctgtccctctgcactctgttatttaagatttattgtcatcctgcatggtgagatagctggtggacattagccccattctcaggggtagctgctatggttgaaacatgctctaccaaaattcgtatgttgaagtcataatccccagtaattcagagtgtgaccttacttggacataggatctttacagaggtaatcatgttaaactgaggtcatttgagtagaccctagtataatatgactgatgcctataaaaagagaaatttggagatagactcacactcagagagaactccacatgaaaataaaggcagatggccgggtacggtggctcatgcctgtaatcccagcactttgggaggccgaggcaggcagatcacttgaggtcaggcattcaagaccagcctgggctatagtgaaaccccgtctctactaaaaatatgaaaaatttagccaggcgtagtggtgcatgcttgtaattccagctactcatgaggctgatacgcaagaattgcttgaaccccagaggcggaggttgcagtgagctgagatcacgccattgcacttcagcctaggtgacagagagactctgtctcaaaaaagaaaaaaaaagctaaaaacacaaaataacagcagaaatcaggatgatacatctataagcccaaaaatgccaaaaaatgcaaaacaaacaaacaacaagaaaaatccatgagaagctaggagacaggcttggaacagattcctcctcacagacctcagaagcaccttgatctcagattttcagcctccatcactgtgagacaatcaatttctgttgcttaagccacccaatctacagtactttgtcataacagccctaacaaacaacatagtagataaaaacaaaaaacaaacaataaaaaaagaaaacaaagaaggctaaatagcttccttctgaatgtggatcgtttcatcagaggatttgatctactgaaccttctactgcactaaaaattctcatttcatcaagtataatgaactgaagtcaaagggatttatttgatgctgaaccaagccaacactctccccaccccaccttagtctaccgttaacgtgtccgaaattgcatgcgttgttttgcttggatgttactagcccttgctgggaaaggtacttggcactaatgtgactatttaaactaatattcacaaagcagttaccctgtgccaggcttatatggattcatgtaattctcacattaattctgtgagactggtgccatgactatgccacttacatatgtccagccagaatctctagttataacttgttcctggtcatacactctgctggttgtgaatccagcgtttgaactcaggcagtctgaccctgggggtgacatttaaactactttattgctgggttctatgttctcaaaagtttagaaggtatttgttaaagagaattggaatatttgctatggaacttgtcagagcttttaaatatgctattatcttagggaatctctgagagtgtggtaaagtaagcagcatttctagcacatagttaaccgtgggtctctttttattaaggcaagatctcttgggactggtgtttcttgaatagacttgccagacaaaatacaagaccccattatgaaatttcagataaacaatgactagtgttttagaataagcacatcccaactattgcactggacatattaatactaaagaatttgtgtttgtttatctgaaattctaattttactagggcgttctgtatttttatttgcaaaatttggcaaactatatgaaagatgcttcgaaaactatagagaacacagccaaagatccctgcctctcccaatcttctgggcctctttctttaggaaacaaacataaacctgcccaaactgaggttgtaccctttttacctgccctgttaccttcctagcatccatcttgctgtccttcattctgccaccctggggttcctatcaaactctgcttcctgtctcttatgacttagaacatgccatcccagacccagggaacagaacaggcatatccctggttatttcaaagccagtatcacaccagcatgtagagatatgaccagacaataacaatcctcctccagttatcactcgagggaaaggagagggacttatggggaacagatgcagataaaacccaaatctgatgccttgaggctggtcagtatgaagtctgtcctgtggtatccctctgcaacatttccatttcaggggagttgagggcttatcaagcttaggaagcaatgtgtactgaaaaggatgaggtcagttcggggtctgtcaaatcaattgaacatatcttgaaccctgaattctatcatcaatctcactttacaatccatcccttccaattaatgctgcatataataacaccactcaatgatgttcatacatcccatcttcttacttggcactatcttttttttctttttaagagattaatttgtctttccaatatattcaagttatcttgaccaatgtttcagaattacttagagctttatggattgcagcaagaccgaagcaaatgaccactcataattcagaatatttctgagccagaataaagtttacacttcatgaccataaagaggaccctttatgcttgtatgtagaagctcaattcaggttccaaacctgcactgtccagttaggtagccactagccacctgtggttacttaaatttacccttaagctaattaaaataaagttaaaactttagtttacgagccatatgtattagtctgttttcacacttctataaagacatacctgagattaggtaatatataaagaaaaaaggtttccttgactcacatttctacatggttggggaggccttaggaaacttaacaatcatggcagaatgtgaaggagaaacaaggcacatcttatcacagtaaagcaggagagagagagaaaaagagccaaggagaactgccaaacacttttaaaccatcagatgttgtgtgaactcactcactatcatgagaacagcttgggggaactgcccccatgatccagtcctctccaaccaggtccctcccctgacacatggggattaaaatttgaggtgagatttgggtggggacacagagccaaaccatatcaccatgctagccacatttcaaatcatcagctacgtatcgctggtggctattatatgcagtacatacatactgcacagtgtagatatgaaacgtttccatcatcatagaaagctctcttggacagccctattctagatgctttattctcaaacatgccacaggataacacataagatattggcatggataccattctatttggtttgggacagaagaaataaggaaaaatgtttctgaaacagggagtccattttagattattttatatgaagttatcaatagtttattaatatattgattaaaagatgacaagttctcaacccccacgatagcccactggtgaagacagaaccatgcagacactattaattcggctctgtttctttttctaatgagccagtgtggagactggggaagaggaagggattgtttggaaagatcagagcatccaggagaaactgtatggggatgggggcaccactgactgaatcagagcctccagtttgctttgggtgaccacagagggactgaacaaacccctgtgttgtcagtccttagttttgagaatagccttgaccagcacacttgttcactgaggaaggatacgaaaatgcagataagttaaaacaaacaaacaaacaccgtcattcttactctggcagccagatgagtcaccaacacattaaattctttatagatctctataccttcctttatgtaaatgtgtataatatgctcacaaaaataagatcataatatacatactgttttttcaacctgcttttttttttttttttttttttttgagacggagtttcactcttattgcccaggctagagtgtaatggcgcgatctcggctcaccgcaacctccgcttcccaggttcaagcgattctcctgcctcagcctcccaagtagctgggattacaggcatgtgccacaatgcctggctaatttttgtttttgtttttgtttttgtttttttttcagtagagacggggtttctccatgtaggtcaggctggtcttgaaatctctacctcaggtcatccacttgcctcggtctcccagagtgctgggattacaggcgtgagctaccattcccggcctcaacctactttttaaattaatatgcttcaacacatttccaagccaaaatgacttgtaaaacgttgtacttaaagattgtggctacgcttggtggctcacgcctgtaatcccagcactttgggaggctgaggcaggcagaccacgaggtcaggagttcgagaccagcctgggcaacatggtgaaaccctgtctcttctaaaaatacaaaaattagcctggcgtggtggcaggtgcctgtaatcccagctactcaggaggctgaggcaggagaattgcttgaacctgggaggcgggggttgcaatgagcccagattgcatcactgcactccagcctgggtgacagagcaagaatccagctagagaaaaaaaaaaaaaaaaaaaaaagtccttgtgcattaatctgttctataggtgtttttagtggaacatttagtgggggtccagttcatccccaattataaatataattccactgagcatcctcaactttgtgcacattcctaataatctgcaaggaatacatttatggaaggagaattactgtcttaaaagggggttggggtgggtatatattattaaagtttgcgataaaagtctttagttgcttgatgaaatggaggcagaagtttaatccctaaggacccttctaattccaaagttgtctgagtgccggattgtagctctgttgagcctgggtcttaagtctgagcgagcccttagttaccttcctctcccatcagcctgagccagagttagcctgaggtcccaaactatgagcaggagaatgtcaccctaggaatggcaactagaaagtttttaccccggatgccatgatgaggcactgccatccactggagcttgctgtgattatggaaatgttctctatctgcacatccagtatgataagcactgaccacatctggctgctgaggacttgagatgtggctggtgtgaccgaataactgggattttaaatcttatttaattttaatagccacatgtggctagtggctaacattttagacagctgttctaagagcatacctctgagactcaaatactcagatctttgccacattgttttatcttaaatatgacaattgataacattgctcatgctcagctgcttgcttcaaatgacatttatttccctcgctagttcttcaaaggtagggactaatcaccaaatctccaatgatagtctgatgccatccccaggtctgctacagcacaaaggggaccctcaatgaataagcatgtcaacatcaatcactttcctcaaagtttaactcagctatgatagatcatggcatatccgcaagccaagctactcatccaaaatatggagatcttgtaagttggagattgtgatgataatagtacctgtcccttagtattgttgtgaggattaaatataagaagagcacttaatattagtgcctagtgcagggtgagtctccagtgaatggggaccattactcttgcctccaacattgtagcaaggtcccctccacatagggataagcctgtcaagacccacgcctgttactcaaaatctcttttagggttatttaaatacgtggtcaagtattgcattaggagaaatggcttaagaacaagagaatgtcaaaccaaattgagttccccttattgtgtgctctcatgaagcacttaccacaatgataattatttgcagtagtattacctaatacctgcttttcccaccatgctataaacacaccagagcaagactgtttatcttgttcacggatgtattcccagtgctaaacatatagtaggtgtttaataaatcctgaatgatagattgaggatgagtgggtagtagatgggcaggaataaaggagctacgggaaaccctagcatagaaaaaaatagtaccagaacccctgaaatctagtcctgtttaggttcacagctaactatcggtccactgaaaagccctggttttggcttctctgttttataaagtgaaaaaggttgatccagattagggtttttcagcctcagaactatagacatttggggcagataattatgttgtgggaggccgtcctgtgcttataaaaggatgtttaatgcacctgtggctgtacccattagctaccagcagccctcctccgccagctgcgacaactaaaaatgtctccagaaaaatgttccaagcagggaaaactcccccgccgcaccccagttgagaaccactgatttagatcctgtctgaagtcccctctggcactgatagtctaagattcttcttgggaccataatttctgaacatgtgaattttctgacatttcatagatggttatagaattataagaatatttccagctactcacgcaaataactcagacctgattatcaatttaatatttggatcagtgggccattaaaatgctgatttgaaattcaattttccatttttaaaaatgatcactttgtgaattctgttagctggttgattttatttaaatggagtgtgtaatttttcccgctctgtgttcatgaataacgctttatagttgaatgtcagaatgcctgctaatgaccctaacaatcatagcttatttctagagaatccatacagtcattgaggctttgttttttttcatcttccactcgtttccttggaataagacctttaattaatgctcattaagatgcacaaatagcctggccttgaatcctcccagtgtttggttcactctcccctaacttattaaagttgcttctggaagttacatagagacgtgcagttaattcctggaacagtgtgtttgtgcttctcattatgcaaaaaatatacaccttggtcaaaaaggaggtatatttttacacaactatttgttcataggacatgtatgcattaagcctcaacaaatgcgccaccctattggcaattatggaattcgagtctcacatcagagcaaatgtggtggtggcctagtaggactttcaatccccttccttggaaaactgccttagtaaggagttcagggattccaggaaatacaggaaagcctttgggatgtgtagtcccattcatatgaaatccacatttcccagaagaccacagaacttttgtgttccatgcagtgtccctagcactacaagctattatctccttaaatctctcaaccctatcaggcacatgctaacaggaccatgattttactatcaacaaaagggaggatgggcgcggtggctcacgcctggaatcccagcactttgggaggccgaggtgggtggatcacctgagatcaggagatggagaccatcctggctaacacagtgaaaccccgtctctactaaaaaaaaaaaaaaaaaaaaattagccgggcgtggtggcgggcacctgtagtcccagctactcgggaggctgaggcaggggaatggagtgaacccgggaggtggagcttgcagtgagccgagatcacgccacggcactccagcctgggctacagagcgagactctctctcagaaaaaaaaaaagaaaagggagcctccctagagaggtgttaagtaacctgcctgaagtcacagaaccagagtttgaattcgtctccccagatttctggaattgcagtcttttccagtgctacattgcccctagatttaggataaaatacaaatgacttatattttccacttaaaagaagcattccttagcatcaaactaaagttagttcaacatatattcctatcaaaataggttaagtttttttttttttaatttataagtgcttatgaacaggaaacgatgggagaatagcttactttcaatgactgctttgagcgtctaattttaatccatatattttctgtaggccactgtttgtagcttttagagtagatttccctctcttaaaagtaaactttgttttacttagaaaacacagagaccttggagcatagtgattgttgtgtttttaaatttcattggtttaattgtcgtttaaaagtaaggttttttttgttgttgttggtttgtttgtttgttttttttattaggaaaacattctcttcatcacatagccctaaatcaatcaacatattttaagagaactgaaatggttttggggtaactttatttttgctattgtagtctttggaggaaataaatgcaaatgaaaaaatcagttaagatcagacgatggatgtattttttttttcacatcctttcctttataaggttaggaacaaacaaacttcctaggaactatcctaatatggattatcataatctatgtttttacaaaaatagtgccaaggaatggaaccaatttaaatggcttagagcatgagacttttaacgtaggactcaccttttggtggtagctaactgaaatgacatcagatctgtaaagaagtgtcccatcatttaagatttcttcagttacaacctaaaagaagccatatgtttgaagtgtgtgctttgtacattttatgtgaaaacatggtcccagcagtccatattatcttggaactatgcagactcccgaagccatgcctccttttcacagacgtaattattagactatgcatgccaattttaattctagaaaaacggtcactctaggtaatgttctttaagacaaacaaacaaaggctgcttaatccatgatgctgtagtcatttgttggcttgtttattttaatccccaatttacaacaaaatgtgttttttttttcttacagagaacccacaatcctattaacagcgaacttctcttgaatgaaggcattacagcagatttaaatccatgcattacaattttagcaatttaatgaacatcctatttggcgacattattgctttaaaggaataaatcacaaacattttacttcccactagcactcggtatttcaaatccattttctctacagaatgatgtgtttaaataaattgtcctgttgactgaattttgatcacattattgggtatttgggatagaaatgtgtagacagagagtcagaagtcatcacatctactgaaggctttgcagccaagaaatgaggcctcaggcaagtcatttagtattaggggacttaatttcttctcagtccaaggcaggtgtttaattgcaacgtgtcccaacttgactaggggagtttgttcacagaatcaagcgaattcccatcctcaccctcacatttggatttgataagtctgcagaggggtccactggacctccttgctaacaagctgtgggtggctctagcctaggtgcccaggtgccccataaaggaaccactatgtggttaataccagaagtcccgtcaagttggaagcttctctaaccacatcttgggctgtagtacttgacaattggcttttcttcaataaagcaaaaataccctcagttatgtcatcattaaaatgtacatgagctagaatcttatgcctgcctggttctgtgagttcaaaataagagaaactcaggaaggttgagttgagccgcatgctgaaaagagggggagaagaggggatgacttggagccaggaaggcttgtgggacagagcttcttaacctggggtgttcacccttggtccctggatggacttgagggagtctctgaatgcctgaaatcacaggcaaagtgagtgtgtgtgtgcatgtgtgtgtgtatgtgtgtgtatttttctggagagggaaggaccacagtttgcatagatttcccatggagatgttgattgcaggttggtcagaaccatccttctaactaggtggtgatttggagcacaggcgtcgggcacagagaccctgacttagagcccatctcttctattaattagctgcacacagaagctggattcccctccaagcgtgctctacctgtggcaaagtgctattgtgggactacttgggaacataggaaaagtgtgcattgtctggtactcagtaattgctcaataaataccagctacatcctaacaaatattttatggaggtccttaaactgagcaagagcaattttacctgatgcattttgaaaggaagtgatgattaactaatccttcctgcctcctgctagtcacgccttacatcaccatattgtctctttctcctcatctggatctttcgctaaagactgacaaagaaagcttcctctgatggctctggtctccagctaaggccataaactgtgtattgttgaggctgcaggagaaggtggaagagtcataatgccaggttcagaccccttggtcttctgtctgccatgggtttgctgtgctctgctagggaaaataattcatcttttgaacccctctgggacatttctgtgagttttgttggatggtcatgtgtgttcactttatgatctccacgtgaaaggtgaagttcataactgccaccagtctctaagctttgtcctttaaagtctgcggacacttgaagccctctgttagtcatgccatgctgtgatcaaaaggattgtgtttaagaatgtatagtctaaatgcttattgtgatcactaacatttgtatagttctttggggtttaccaagtactttacttgtattttctcatttaatcttcacttaggactaaaaaagttagtaacactaatgggaatgagcgaaaaccaaattcagacagtattaaatacacaaaattataaagtaaaatgagactgatttcccacgtcatgaggaaaaatgtctctttactttgtgattctttttatcacatacttaaaggcatttgcatttttccttttctgaattttctgcttttagtttttcctcttgtattagatgttcagtgtaactcaccaattgtggcagttttctgtttgattcacagtaaaaaagaataaaaaataaaaattaaaaaaaaactgtgacctgcattgtccacctgattaaaattagtttggatttttcagataaggttccttctttttattattataaacagactttatcttaagagtcggaagaaacatttaagggaactattcgtcttatttgtatttcaacctgataaaaggaaaagggatatagcaaaaatttttagtcgtttgagtgggaagtgctttatttgagataaacacaaaaggttttaagtatcgttgatattagtcaaacataatagcttttggctattgtctgaagagctcttgtctgttgacttgcagacctgtgacctctagataaagtttcaaaatgcagaaaatatttatcttcttgctatgaccttccacgcacacgacgtgaagccatggatttgtttcctagggaactagtgagtgaggaagatctataattaaatctgtgagttatatgctacacatgggaattgggtacgcaccaagtcctttagaaaaatcccataatatcaccatagcctcaactggtggaattaaactcaatttttcttcacacatttttagaaagcatcattcagaatcttaatatgggaaagttcttgtgtttctttccaaagtcagggtgtgtttagtttggcttccatttcgctctggatccagtgtccctccctgatgggacggcacctgccattgctactcaggtgagtgctttatatggaagtcttggaaaagcgagtggtagtctagtctcagacatcagcacgtcagagctggaagggatccaaggcagtgtttggcaaaagttttttgatgttcaaaatgtgtccttcaaataaaatctaatttaaaaattcactgagtgaagcagacattaggtgaattggttttgactagaagtaagggagaaagaaccttttcatcaccaccccaatcccaaaattccagagcaagaagtctctaaggcacccccgtttctcaacttgaacattaacatctaagccatagcactgattgtagagggggcagactgaggctcaagagatgttgccattggtcagccatctcatagcctctagaggttaaacacacacacacacacacacacacacacacacacacatacacacacacacaactagtaaaaaaaaaaaaagtcagaacaatgaatagctgtttccaaatctggcttgaatatattttgtagtaaatttccccatctagaggctcatgagggccaagatttctctacggtgcttttatttttcaccttttgaaaccaataatcagcctcttacattaactctaaaaagtaaaactctgtcgactctttgctttcaatgggattgtcctccccgtatcattcctcaaccaacagagggactctatgagagggaagcagaacctcaggactaccagagaagagatatttcacagataccaaggcttgacgtagatgtgaggccaggggcagggtgcggtggctcacacctgtaatcccagcactttgggaggctgaggtgggtggatcaactgaggtcaggatttcaagaccagcctggccaacatggtgaaacctctcctctactaaaaatacaaaaattacctgggcatggtggtgcacgcctgtagtcccagctactcaggaggctaaggcaggagaatcgtctgaacccaggaggcagacgttgcagtgagctgagatcatgccattgcactccagcctgagcaacagagcgagactccatctcaaaaaagcaaagatgtgagtccagggtgggtgttgatgaggacggtaataatacctgatgctttcgtagcagtccctgctccagactatatatacattagctcatttagtgtttgtgatgtctaagccgtgtgtgtgtgtgtgtgtgtgtgtgcgtgtgtgtgtgtagtagcagcttattttttttctatttctctttgattttttaaatacacacttataagtgtacatgtgtggtgtgtgggtatatatacactttcctctatctttctgatatacctatctatatatttatgatcttcccaccaacctggtaaggccgatactactactatccctattttatatataaagaaactgaggcacagaatcctaagggtcctacagctggtcgtggcagcactgagatttgtatccaagcagcctggcttccaagtctgtgctctttgctggtctacattcataccccatcttttatttttctttttgaagtatacgctatggggctttgagcaaaacttctgatgtgaaaaagaaataagaataataactccaaagatttttgctatgaggataaagcacctgacctactgcaccttgtaatttctggcaactaataatttctcagtaagtttctgtgttgctgtaaaaattgtcaaccatgtacacaaacagatctttaaaaaaaattgagacaaattaaagtgaaagacttcaaaatcagtttgtcacatttgatgctaaacgctatattttctctgagaattttaaattgtgcaggtaatttctcaccacggtaagtcatgatttttcatacttgaacagtatcacttcatctaaggaattttccccagtgcagtacactcccacccatgcctctgaaaacgtctaatctgtttctcctacttacctgttggtccaattcatttctggaaatgttctgcaggttatcataacgagaacaggagtgatctatggaataaacaggcactgttgtttgaattaattaccaggaacagaatcataagtggtgacaacttacaacagctcattccacattctcctgccactgatggatagatttatgcatttgaaacattttttactgattgcctgcccatctcctgttcacatactccctgagaacctctatgtcttatccatggagtatgtccgaaaaccaattatcatcccctttttgtttctgtattgtctaatggaagaaaagaaattataccttagaggagatattttcctgataaacagcatttagtcatttagtcattaaattagctcttttaaaattgtattatttttaaaggcatctttttattttattttattttattttattttattttattttattttattttattttattttattttattttatttgagacagaatctcactatgtcaccaggctggagtgcagtggcgtgatctcggatcactgcagccaacctccgcctcctgggttcaagcaattctcccgactcagcctcctgagtagctgggactacgggcacataccaccatgccaagctaatttttgtacttttagtagagatggggtttcaccatattggccaggagggtctcaatctcttgaccttttgatccacccgcctcggcctcccaaagtgctgggattacaggcctgagccacagcgcccggcctaatggcatcttagtcattcgacttttcgagacagccttatcagtagcctctgatgcttgaggttctcttgtgttgcttttcgttgtcatagtatttttgttgttattgttttgtttttctttctttttgttatttgctttatgtttgtatttgtcgtacgttgtgtttaatctaccccttctctgcccaagactgtagtatgtcgtcagggttgagaaccactgggttaaggagttacaaaaagttaaatttctcagggctaatgttgaattcttgcatcggatgagctcattgtaacttaggaaaatcaaaagcttgacttgaaagaatgagacaagtcaagctcttgtgagacaagccaactctttctcatgtggaggaagagttctgatggggagaaggagctgaagaagtggtgcccccattgaagcaggcagctgggatcccctgtgaaggtggtgaagggcagatgggagacggagatattttaatgaaaattgtaacctattttatgaataaaatttattttttattactgtaattttttttttgagacggagtctcgctctgtcacccaggctggagtgcagtggtgtgatctcagctcactgcaacctgcacctcccgagttcaagtgatcctcccacctcagcctcctgagtagctgggactacagttgcctgccaccacacacaactaatttttatgtttttagtagaaatggggtttcaccatgttggcctggctggtcttgaactcctggcctcaggtgatccacccacctcggcttcccagagtctggaattacaggcgtaagccaccacgcctggccccaaacaaaatttaatttaatccttacaacagtcactcaaaggaagaaggatatttgcattattagagcaccttcatgagcttgacatttttatgttgctctttgaatcctctcaaatgccagctgatttaggtttcatttttcccgtcatcagtgataaaaccatgacttgaggcaaaggtgactattcagaaccagggtttctgattctactgcctttttctactgcttggatacagcctggcctgaagcctcagggactttaggatgtagattggcaggggaaatcccaggcaggggtgttttttgatgggagaagctgtttgcaacccgcagctctggagtgactcagagagagaaatgactaatttctccattcagcaaaaatgcattgagctccagctacatgatgaggactgctgtaaattccgtggacacagcagtgaacagaacagaccaagccctgtcctacagtccacctgctagtaagggaacctgacaaatcaaaagttaataaaatacatggtgtgtcagttgctatgataggtcctgataggggctatggaggtcaatggctagagatgagagtaggttgcagttttcaacagggaggccctcagtgagaactgatgaactgggatgagtgcagggatgcatctatctgggggctgagcatcctcgataaaaggaactatgagtgcaaaagctgggggcagtagtgtgtccagaatattctagaaactgtaggaaggctggtatggctgaagcagagggagcaagggaatgttagataggagaaaagctgtgaccagatcacagaaggtcttggagcccaccatgaggactttggcctttattctaattgagtgggaaagccactggtgggctttggtgaagacagatgtgatctggcttatgtctttattgaatggctctggctgacggatggagaatagaatagagtgtggatggggcaagggtaggaacagctgcaatcactcaggctctagaagcaatgggggcttggcccagagcaatggtggtggaaggggagaggcgtggttatggccgtattctggatataatttgaaaagatttgtcgggggaagtgaggattttagctctgttttattgagtgtggttgcctgcaaaccaggctctgcgcctctctgaactgtcatgcattctttttgagtcctcttggtggttttgtaaagaagccagcctcgctgcccatctcccagaggggggaaactgaagctcagagacattcagggatttgcttaaagccccatgccaggcgttggccatggtcctggctcccaaacctgtcctttttctactgtaacaggctgcctcccctccaaagtctgcaggaaatttaagcctcctggaatttcttattgtatcagcatgaatattattaagtttcctataaactcaaattttgtgtatttaaaaagactatgaatctttctttttagaaattgaggtggttaggattaatgaccaaccataaaattttataagcaattattacggtttactgtaccttcttcagctgcttgtcgccttgccttcttttctttctcctgtagtcggggtgagttttcacatcactgacaaagatattgggctgggaagaggcacgcttggagtgagacccttcaggaagcctctgtttttaactttagctgtgacactgggatctcagtcatggaagttcactgacatctactcatcctgcattagtaatatgggcatggtgcattttctgtatttattagctatgtttaacagaatctttagaaaggaactcgatgccctgtttcaacaaagtacattgattttttgctttgtgatagataaggcaaaagcggtcactttgttcggtgtgtgctctcatcctaatttagggcccctttctgcctagaactctgtagatttccgccgtctgtgtttttccatcatcccagaccctcagctgcaagctcaggcctccagcccctcatgcacaactgctcctttagatcaggattactttgcccccagtctccctgggacttgctgcagatttatttcaaagttgtaaatcctctgtggattacctcctcatgctattctcaacctctggttctttctttttctgattgcccccaatattaacaaagtggagcaaaaataactacagttgctggaaagtggtactgtgttagtcagaacacagaggttgtatgtgacagatacacgttcacatggctaaggctaaagggtattcattgactcccatagtcaggaaatccaaaggtgcatctggctttaggacagctggatccaggcctcacacagttgcactttgtactctccctttgcgtggtagcctgatcttctcctgccacagacacttggtcaaagaagctggtcacaagctgcatccttctagcactgtgaatattaaaggcaagaggaatcttccctctgagcctggtgtggtttggctgtgtccccacctaattctaaccttgaattgtagttcccataatccccacacgtcacgggagggacccaatgggaggtaattgaatcatgggggcggcttttctcatactgttctcatgatagtgagtaagtctcatgagatctgatggttttataagtgggagttcccctgcacaagctctcttgcctgcccccatgtaagacgtgactttgctcctcattcaccttccggcatgattgtgaggcctcccccaccatgtggaactgtgagtcaattaaacctctttcctttataaagtactaagtcttgggtatgtctttattagcagcgtgagaacagactaatacacacatctaacaagaataccccaaggagaatactgtttggtataacattgggcaaatgcccattgctgtagccatctctgaggccaaataaatgggttccgcttggctagaagtacatctcattatgagtggaagtgggggaatgtcatggcaccatgattgtggtacagctgattgtcatggggcaagtgggagggttgatgtaagaaggggttggaaagcctgctgggtaaacaaatctatagctactgtccttcaccatagttctaccaaagtcaaattgcatttatagcactggagtttcacttaaagggaatgcagcactggggacagaccctagtattttttccaattgtcctttattttcagttgccaccatgtcttgagcgcctgccctatgcccccatactgttctaggtacatatgatggcaaaatgatgaataacacattgactctgccctcacaaatgctgttcattaggatgggtcttcctaaattatagagactgatcaatttacatgccaccctttgatgctaactaagacaatggagaaatagccccaagtgctaatactctgtctcttgaattgagttatttttccaaggcagtaaaatgtgaagattgcaattagttaaccattatgaagacaaatcttcaaatatttttctcactgtggtgacatttaaaatgcttcctgctcaaccaaacagccaattgatttctttcccatcttcttataatggctaattgctaagcaattgattgaatcctcttttgttactatgtaattactaagctggccaaaacgactctcccgaccatttctcagttggctcattttggtcacctataggacaggtttggggtgggaatgttcttatttggttaaactttttgcaaataatcaatcaaattgctttatgtagtgattccgagcaaaggtccaactggcagaaaggcttacatattacttggatagtttcttaacctaaactttggtgaagtttttgttgttgttattgttgttgttttgtctttgatatggaaagaataagaacctgcctcctgaaattttgggaagggtcatacgagataatacattttcagtgtttagcaccactgggacagaataagcctgtaacaaatcacaagtgttaatagtttgtctaggccacctctactgcatgcttatgggaacatggtcaacattgttaacttttgtgcctcagtttcccaatctgtaaagggaggataatagagccactcatcatcaaataaattagagtttatttgatgattgtattagtcggggttctttagaaggacagaactaataggaaatatatatatatatatatatatatatatatgcacatatatatatatacacacacacacacacacacacacacatatatatatatatatatatatatatacacacacacatatatatgaaggggagtttattaaatagtatcaactcacatgatcacaaggtcccacaataggccatctgcaagctgaggagcaagggagccagtccaagttccaaagctgaagaacttggagtttgatgttcgagggcaggaagcatccagcatgggcgaaagatgtaggctgggaggctaaaccagtctaggcttttcacgtttttctgcctgctttatattctagccatgctggcaactgattagatgatgcccacccagattaagggtgggtctgcctttcccagcccactgacacaaatgttcatctcctttggcatgatcctcacagacacacccaggatcaatactttgcatccttcagtccaatcaagttgaggctcagtattaaccaactcaatgataaaaagagagagcaaaagcatgtagaattgatatgacggttaaaggggatagttaaggcacctgaaggaccaagcccaccagcaatctgcacggatactcggtcactattttgttatttataccacctggcacagttcctgccttctaattcacactcaagcctcaagcaagagccgttcctttgcctccattcctcccagagattccccttcccatgctgaagccttggaaattattgtgaatgcaataatggtggccgcttctgtaaacactgtacttgaccttcatgcccacagtattcagcaggtaactacgtagtgtctgttgtgtgtcagggactgtgctgtggattcacttctgcagagagcagagggtagatgcagaataaagggtcttctcctgccttgagccgttcagagttgtggcctttggaagacttgctcagaatgatccagtgcttttttgacatttctggatatgatcactagctgcaatcttgcatttggtgctttttgtgattcccagctctccctccacatgctctgagaaaagtgatatccccagagctgtatccaaagaagaaatgtaaatccagaggctataaactaataggatctgagtttccgtggttgactgtatgaaagtagatttggcttctctgtgttgctgactttaacagggagcttaaaatgtgagatggagcaggtgtttgcgtgctgtatcaccaagccgttcccatggctgtgaattccgggaagttgagggactatacagacactttatcttgtggtgacctgatgcatgcaccaggccactgttgcccaacaactgccccctaagtgtgggtggaacggccattgcaatcgactcggggcgaacagtgcatctaaaagatgaaggtctgattttctttgcagagtttaaatggtgcatgtgtctttaccccaaaaaccacagaaacaatttctcttaaagagaaagagaggaactatgtacttgggctttgtatttggagattttggcaaagatggaggctgcccatcatgggtgacggtagaatctggtgtcagatggcacactcggagttgtctgactcacttggagagtacaagggcatctgcacctacaggcattgctgtgaatgacagaatcatcaacatccagggaaatgctatacttgaaaaaaaaaaaagatcagggtattagccgtggcagctatgtggcttctagatactgagccatcctagatgctagctctttacctgcatgatatcatgcaaatcttggaagcaagcctccaggtggattttattcctattttacagtggagggagctgagggctagagaggtttagtaatgtgttctctgacacatagattaaaaagtggctgagcaagaacttgaatcgcaagccctgcatgccagttgcgagccccaaaccctacctcctggggagaagacacacattgtatttctcttctcttcatgggggttacagactccgttatttcagagcagaacctaggttctctataggatggggaggtataaggactcctttctatgcagtggaagcctgtgtggtctccctgagaccttttcccacaatctctgaatcccattcatttgtgcaagagtcaagttcaaaagcagagagcttgagagctcctgtcttcatcacattgttgacttatcgttacatctgctcttctaacttaaatcactggctccttttctttcttcctctgcatcttcaccaaggagtggtagaaaaagaattcaccttggcatagacaagcctagatttgattaacagctcttaaaaaaatcattccacctatttagtgttctgcttccttctctgtgaatagggctaacgatgcctatttagattatgaaaattaatataaaaacagaatagaagtccctagtaagttgcctgtcccaaagcagacacttaactaatgtcaagtctccctaaacgttgccctcatccccacaatacgaggagggaagagtccgatgttttcattagaaaagctgccacccacacacaggatgcttttctctacttctgagtgtttatagtttcagtgattctgtgccttacaattttcaaggacagctcgttccaacctttgcgaatatgaagaatggtttttctaaattatataatagtgtgacctacagatagccttgggctttcctttcttctggctgcagcctttgctaggtacacatagggacatgcaccctgacaatccacgggggccccctctggcctgggtcctcagaatgagaacctcagcttttaggactcacaatgcaaggatgatcacgcttgctgttagcagcgcagatccagcgtaattttaaaagcaaaatgactgactacatagaaagaaaaaccacattgttttcctgtctccccatggaatgctgcctccattagagaaaaaggagaaaacccgattaggaaggatagaaacataaatggaactgtgtcaggccttccaagctgtcactgattattctaccaggcagatatttctcacctcccattcagggccatctcctgtaacagccatttctatagccgaaacaataagggataaattaggctggtcaatttgtcctttccctttcttgggtaaaaagaaaacgacttaactaaatcttttttctttaggatgaaaagagattttaaaaaacattctagtagcaaataactgtcctaaagtaggtaaaatgggaattgattttacttacctgacttcctagttgggtagttgggagcattacctgagacgggtctgtggcaacactttgtgacggccaggcctgggtggctattacggtcatcatcatttcaggaggcaaggtggcttcattatgcttcattcctacaatctcctttttgttcattgatgtgcattctcctgctttgacatacaaacccataacaccatgaaattttaaagcgaatggtaatattttttcatataggtaaaaaaagtatgagaatattccaatagaaataaccataaaacattctttctctttgtttgagtaacccctttcctgggtgtctatcctaaggaataatgtaaaatgtggagaattatttttttcagaggaagatgttctttgtagctttatttacatcattcacagtgtttataattaaaacagttgagagtccattatgattgaagtggttgttaaatgatggtatatctgtcttaaatattgcatagctaaacaaaaggagctggtaatgatagaagaaaatgctcatgatataatatgtgtattatagtctgttcttgcactgctataaagaaatacctgagatgaggtaatttataaagtaaagaggttgaattgactcatggttccacaggctgtccaggaagcagagtaagcagcttctgcttctgggatggcctcagggagctagcttccaagcatggcagaaggcaaagtgggagcaggtgtcttacagggcaggagcaggaccaagagagagatgggggaggtgctatacagtttcaaacaaccagatctcctgagaactctatcacgagaatagcactaggagggtggtgctaaaccactaatgaggaaaccccccgccgtgatcccatcacctcccaccaagccccctcctccaacattggggattacaattcgacatgagatttgggcaggcacacagatccaaaccatagcaatatgtaaagaatcaccctagcaacagtcatcaagatagcatgatacagcaggggagagatacatggatcagtggaagggaatagacaacccagagatacagccacacaaacgtgtccaactgcttcttagtaaagatgagaaaggaagtcagtggaggaaggatagatccttcagcaaatgatgctggagccattggacatctgaaggcaagaaatgaacctcaacctaaacctcactcttcatacaaaatttaactcaaagtggtccaggcccagtagctcacaactgtaatcccagcactttgggaggccgaggcaggcggatcacctgaggtcacaagttcgcaatcagcctggccaacatggtgaaaccgcgtctctactaaaaatacaaaaattagccaggcttggtggtgggcacctgtagtgccagctactcgggaggctgaagcaggagaatcacttgaacccgggaggcggaggttgcagtgagcctagaacacgccattgcgctccagcctgggcaacagagtgagattccatctcaaaaaagaaaaaaaaacaaaaacagaaaatgttaactcaaagtggatcacagatataaatgtaaaacactatgaaactttaagaaaaaagtaggaaaaaatcttagggatctaaggctaggcagagttcttatacttgtcacaaacaggtgtgaaccctaaaatgaaattttgataaattagactttatcaaaatttgaaacttttgctatgtgaaaaatcctgttaagagaatggaaagacaagctatagactaggagaaaatacttacaaaccacatatctgaaaaaggattagtatctaggatatagaaagaactctctaaactcaacagcagaaaaccccaatcaaccaaattaggaaattgacaaaagacataaacagacatttcagcaaaggggatatgaggatagcaaataagctcatgaacaaatgttccaactcattagccatgagggaaatgcaaattaaaaccacaacagactaccggtacacacctattagaacagttaatttatttttaaaaagcagtaacatcaaatgctggcaaagatgtgcagaaaccatcactcagacattgctggtagaaatgtagagtggtacagccagtcaagaaacgagtttggcagttttgtataaaactagacacgcacttaccatggaacccagcaattgcactcctaggcgtttatcccagaaataaaaacttatgttcacacaaaacctgtacacaaatgttcatagcagcttgattcatatttgccagaaactgaaaacaacccagatgtccttcaacatgtgaatggttaaacaaactgtggtttattcatatcatgaaatatggctcagcaataaaatgaatgaattattgatacacagcaacttggaagaatctccagggaattatgctgaatgaaaatgctaatcccagaggttgcatactatatgattccatttatatgatattttctttgaaaatgttatgtttatttttaatgtttgtgggtgtatcataggtatatatatatatatatatgcatggggtacattagatacagacatccattgtgtaataatcacatcatggaaagccgggtatccatcccctccagcatttatcctttgtggtgcaaataatgcaattatgtgattttagttatttttaaatgtacaattgaattattattgactatggtcacctgttcaccccgttatgctctcaaatactgggttttattcattctttctaattttttgtatccattaaacaccccttcgtctcccctccccaccctcaattaaatgaaaaattatggaaatggagaacagatcagtggctgccagaatgtgtatctgtgagggaagaggcagtctctgcaagagaggaagatgtggttgtgaaatgacaacacgaaggatcccagtggggatggaatggccttgtatctcaatggtggtgatggatacgcaagccaatacgtagataaaactgcaaaaaactaaatacacacacacacactctcacacactcacacactcatatgctcacacactctgacacattcacacacacacacacacacacacaaagtataagtaaaatggcaaatctgaataagatctgtggattgcataaatgtcaatattttaattgtgacattgtaccacagtttaacattagggaaactgggtaaaagagtattttttgcaaatgcatgtgcatctataattattgaaaaagtaataaaagtcaattaaaatatgtttatgcagttgtatgcatttaaaagactagaaaggatttatcgacattttagtatagttaactatccagtaggacattgagcatcttgctttctaccttttactttactttctctgccaggattttcctagtgagcatgtgttagttttgtaaagaggaaaaaaagcaaacctggttttaaaaaaaaaatcccattgccaagtacaacaatttacagcactctttttagtatattctgaaatagtctcctcatgatttctttctcttctgtactccaaatgtaacactaaatcacacacatgtacacacacacacacacacacacacacacacaatcatgaccagctcaagaataaatatgtggggactaagcatccaaagctcgacaccaacaatttgcagctgaagacataatgaacttttgttagtggatggaccagctgggaagactgtaaagttggatgtcttgttgtgctttctatttattattcagatctccagtccagtgtacagacagaaggtgcatcttgatggatagttcaaaagggtaaagacttagacaaaataatgagaaagggactatttggcgacatatttcatcctctccatcccactctgtggcttcctccctttgatgcacacataatttcaggaacccagagtgcaggattggtagaaacggaataaatatatagtctgttgtatgggaacaggctcagaagcctataaaagattcaactcctgctttcccttaggagaggtacccaaccagtattaatattttagaaatactggaaggtagaagaggagccattattcatcactggcaactctgtggtactaaaattaaataatggggttttttttaaagacagaattgtgaaagttgtgaaactataaaaaatattcctctcttggggatgttgcattttttgcttttatcttttcttcttctcttgagaacattttgatttactactgtgataagcttataacaactagggaacttgggagaaaagacgaggcaggctgggaggaggggtgttatggcagcttacaaatgggcccgggtacatttgcctggcttcaagtcagaaggtgctggagctgggcttggattcatttccattgtgtggcacacatatctcatgcatgggccagggacgtgccttgtgacagttagcacccacggtgccatgtgggcttgggatgtgagcatgcttgtctgctcagcaggaacttttcataaaaggtctagtcatccttttcctgaagcctggaaataatcagccctgctccttgaggagatgtctaagctgttaggactttgttatccaggagttggcatctgaccagcatctggagttttggattgatctggatgatttcagagtgttctgtacctgttcctccccctgaactagctgtgtaacccattggacaaatgacttcacctctctgggtctccttaactgcatttgtgaagttaaaaaaagcaatagaaaccaccaggtaaaatgcacacgtagctttagcacagtacgtggcctgcacaaggcctcagtgaatgcagttattacctaggatgccacttgaaaaacattttaaacccttttaatgataaaattactctccgtgactgttacatgttgtgtttcaatgcatactcatgagtgtcgttaacatttattgagtgcctactatgtgcctgccacggtacaatgtgctttagggatgcagttccattctgtcctcccgaggacctcaggaatgcaggtctattattcccaatcaacagaagggagaactgaggcttagaggggtgaaaagatttgcccaaggttaaaaccaagggcacattagagccagcgtacaaactgacccagaaatcattttctaaaccactgcaccacgggggcaggaatggtggctattgctcgggacctagagaaatgaaggcacagggaatgaagacgaatccttgctccacccatggggagacagtggctgggccagatttaagcagagatccctggacagcgcctcattccttacctgattcacacggtgctgatacgcttgttcagggctgcctcaagcttcagactcagagtcagaagggacctcagagtctatgtggtgctgatggtctttgtaacgccttaacaggatgagggtgtgagcctgggcgctgggtggcagccttgtccatcaccagatgagcttagcaccgtcggccaagttttcaaccccaggaagcctgcctccttttgagctgaaatctgtccattccatagcttgcatcgattggcttttctgaaagttaagactaaaccagtctccttttctgctggtctttagatgatacccaaaactgtacctcgtgttccatgtctctaagcattcaaccacttactgggttgggctgtgctcatcttacacagaacagatctcctcacttttctctcaaatgttttcctccttagtcccctgtctacacgtagcctctatccatccctgtatccttgtgggttagaattcaccacacaacatgatctcattaggagtcatcacctacaaagcaggtattgggcaattgtgtttacccagggtcgttttggggaatattagtaaccgaaacttgagaggaacttaaatctacatataccacccaccaaagacttgcatggatggtgcagtttccgaaaaactttgccaaagcatttattgactcacagctactatgatcttctcttgttgagcttcccttagggaaaacaacaacaacaacatattttaggtagccagagcttcagaggaagagagatattcatccaagttgatctcattgtatccatgagcctgttaattttcagggagcaagattctctagtcttaaaaatgtgtgtgtgtgtgtgtgtgtgtgtgtgtgtgtgtgtgtgtgtgtgtgtgttattgggatcttttaactaggagaatcactcagaatgactctgttggaggataccagaatatctcttggaactcaagcccaagaagcagaactggtccttaccagaagttggcaagccattttgaaaccagggtagctgtgcctgttcattgatttatgcattcattttccttttttcctgaccatatggtctctcatttcagcttgtcttagcatagcttctttatttattaaaaaatatttgagtttctactatggaccatgcactgttcacagcagagaacaaaatgaaaattcctgctagcacagtttatatttaaatggtaaatagagacaacagatataaatatgtcaggaagtatgtcaggtactgagggttcggtgaagaaaaataagacaaggatgatgctggaaggaaaggcactactttctttcaataaggtggccagggaagtcctctgcaaagagatgagtataaattgagatttctgtagcaacaatgtaatgagccacaggagacccatgtggtaaggtcctggcgaattcaagccattaccagacaccactgggaaagggggctgggatacttcagtgtcagagcataatttgggaccaaggctgaggaataagattgagtaacgttggctgggcacggtggctcacgcctgtaatcccagcactttgggaggctgaggcgggcaggtcacgaggtcaggagatcgagaccatcccggctaacatggtgaaaccccgtctctaataaaaaaaaattaaaaaaaaaaaaaacacaaaaaattagccgggcgtggtagcgggtgcctgtagtcccagctacttgggaggctgagacaagaatggcgtgaacccggaaggcagagcttccagtgagctgagatcacgcaactgcactccagcctaggcaacagagcgagactctgtctcaaaaataaataaaaaagattgagtaatgtcagagaagattatttaccagctgtagggtggtgtcaccatgtttgagcctgcatgggattcatttacacaagcattaagaactctatttcagttttccctgtaggctgttttctttgccaaggtctctgctaatggccccatagtgtcccctgaaaatggcggactcgactttcaagctggtaagacttcaaaggtcctcagtctctccctgtcccaatcccaggcttccgaaagaaatgatcttgccaggctcagctttggataggacgctctgggtcacaaagggcagcccgggactgacatagtgctaggcccaagcatggcgcttttggggaaaacggctgcaaaataggatgaggggatgtggacaaactcagcaaaagttgatgctgaagacagaggcagggatatggctataaagagccttgctttcctgaggggacttgaatttttcctgaaatcaatggggtggggggccctggaaagattttaatcagggcatgatccaattggaagagacagtagcggcttcacagagtgagaaacctcaaagctgtctacacatccttccaatgaaggcacatgcaaggcagaacagaatgtcaggatttcggatgaaaatcatggaaattttatttatttttgatactatttacatttccaggcatcagtcttcatgttaaaatttgtcctgaatgataagaataataagagtaagtgttaaaactctcagggaaagggcagtcaacgtgaatttccagccagaaagtcttcagttgttcatgttgattactagcaaatgggaatagtgccaggttcataatgctgattttattacattactttctctgaactctggtttaaataagtgcgtaaatatttggtacagggagataaacattgagtacacatggacataaagacaggaaaaatagacactgaagactccagaagtggggagggatggggtagggcaagggctgaaaaacttccttttggggccaggtacagtggctcacgcctgtaatcccagtactttgggaggccaaggtgggaagatcacctgaggtcacaagttcgagaccagcctgaccaccatggagaaacccatctctactgaaaatacaaaattagccaggcatagtggtgcacgcctgtaatcttagctacttgggaggctgaggcaggagaattgcttgaacctggcaggtggaggttgtggtgagctgaggtcgcaccattgcactccagcctgggcaacaagagcaaaaccccgtctcaaaaaacaaacaaacaaaaacaccaaacaaacaaatttccttttgtgtactatgttcactatctgtgtgatgggataattagaagccaagacctcagagtcatgcaatatacccttgtaacaaacccacacatgtaccgccaaatctaaaataacatagtaaaataagatttaaaaataaggccaggtgtggtggctcacgcctgtaatcccagcactttcggaggccaaggcgggcggatcatgaggttaggagatcaagaccatcctggctaacatggtgaaaccccgtctctactaaaaatacaaaaaaattagccggctgtcgtggtgggtgcctgtagtcccagctacttgggaggctgaggcaggagaatggtgtgaacccgggaggcgccactgcattccagcctgggtgacagagtgagactccatctcaaaaaaaaaaaaaaaaaaaagatttaaaaataaaaaataaagcaaaatctatacactaataaaaaaatttggtttaacctttccctgggaacagtaatggtctgaaatgatggaaagaagaattgaacaactccagggaagtgaagtttggcaagttagcaagagagtaagcatgtatagttcaacagcatccgagggcatgattaatttattgtccttttagatggcagaatgcacacaaaacccttcaaattacaccattattatgacaaagctcagggggtgtgagaagttaaagatgttcctgccaagagtttgatgtacagaggaaacgggcaacccactggatacacataaatctggaaatcgagactttgaagtccctcgtcctggctctgccactgacatgggcctgagatgaatgttcctgggccatgaatggccatgtcacacggagttccgattgggagctcttccatcagtgtcgggctcaatgccttgttgggtctactgggttgagtgctcctacccaactcaggacacgcttatctgttgcccctatgaagtatgggtcaagaccatgggctctgggggatttggttccaatccaaaatctttatctagcagactttggcaaggtttgtgggactcagtttcctcctctgtaaaacagattattaccaatacctacctcatagaattgttgtgcctgtaaaatgctaagaatagcatgtgccggagtcagtgttcagtaaatggtagcagctgtcattgtcatcatcaccatcattttaaactgttgagcatatttatgtacctaagcatttcctatgtctcaggtcattcactcaccatgagcctttccattattttccattgtgcagaagacaggagtgaggctcagagaggccacacagctttctataagtccacgttgtccgtgagccctgaactgggatgcagatgcgtttttatgtgtctctaaaccctgctctgctaaatactgtgtgtgttaatcaggataggttaggctttggtgacaagaaaccccaaatttcagttgatcaaaaaaacaaaagcttgattaagctccatgccctcagaaggttaggtgggaactgtgttcctcgttgtcattgtcctttctttgggacccaggtccatgaagtcactacaatttggaacattgctggtcaccatgaggaaggaaaagggaatgtatctaggcacactagagttcctaatgctttcgcccacaattaactgaagtgacacatatcactttcacttacacttcactagctaacgcaagtcccatggccacatccaggtccaaatggccaaggaagaacactgctgtgtgcccagaaggataggagcccacaggggctgaggcagccaccatgattactttctgataccataaatctgatctgtgaatagaagagatgggaggtacaggagatccagggttttcaccagagattccaggagccaccttgacttaaagcagaacaaccaaaggcaaagccaaggagagtgttttcaaagggctcagtgatcaggagagtgaaacacacagcatgcattaagaaatcagaaattcagaaagagacacttacaaatacctagttattcactgggacaataagggatgtaaaattatggtactgattggcaatttggggggtttgggcccagcaaataaaatgcaatgattgaatgacccaaagatgactcctcctcctccaatctgctgaggcatctttcagcgcatctcccatgttatgtaaaatgaggttcatagagtttattgagcagtggtcccttgaaggccatgagtactctggaagtcagaaatgatcaataagtattttgaatgcaagaaaagaagttgaggggagatcatatgttacaagaaatggtgcccaagaggaaaaccttttttttttttttttttttgagacaaagtcttgctctgttgccaggctggagtgcagtgacgtgatcttggctcactgcaacctccacctcctgatttcaagcgattcccctgcctcagcctcccaagtagctggggctacaagtgtgcaccaccacacccagttaattttttatattttactagagacggggtttcattatgttggccaggatggtctctatctcctgaccttgtgatccacccgtctcggcatcccaaagtgttaggattataggtgtgagccacggtgcccggccaaaggaaaacatcttattcaaaatcatgagagagaaactgaccatgaggctgagcgaatgtcagtgtaggttgggatatattattaacaggcatagactgagctcttacagtgagaacagccttgtgctggttacatatttcattacggggtggcctggtgtgctttgggaaggacaggcatgaaagggtgactcatacatggcctatgggtcctatgaggaaatttacctcaaccaggggaggaggactttcggcagcttttcccttctctctctgtctgcttcttaatatcacaaccatcttctcaaaaacaaacacaagtactgattgcctacgaagccctctggccgtgatttctctgacaatctcagaattcacctaagacttccctctgcaccatctcatgctatcttcatcttcatctcatgaaggttcatattgcagcttctcatgcacatctcatgtccccaggccaaggggctgggcatgagatccactgcacacctcctccagtgtcacccatgacgtgctgcaatggcagatccctgaggagctgtgccctggatctcatgcccagctccaagatcagcatgccaggcattctcacatgcacccgacagttttgtccttttaggaaaatgtcgagatacattcattcactagatgacaaatgtttgaggaatcactgtgtgccagaaactgggtttggctctgtgggataccagcgaatacaatcagacgtggccactgctcctaggaccacagagtctaatcagagagatggctcttaaaccacaagagttacataacatttcaacagttgtgttgtgtgggtgagctagaaaatttcaaaattatatactggaggaatttgacttggggggacccattattttctccaatcaagagaccaaggacactgaccagagtatttttctttacagagcctcctagtgcctacaattcacaaaagggccttgaccttctctgtgcattcaaaccacagtaggttaaacaaacaaacacattaagggaggactggataaaatcacctgtactcagactaaaatacttcggaatgtgacagatctggaaagcaacataaaagcaaggacatagaggatctgaatagtttaatcagttaatactagaaaagatagataaatatggaactatgtggcctacaaagagaaaatactattttttttaattgtggtaaaatgtacatggcagtggcattaagtacatccacattattgtgcaaccatcatccccatccatctccagaacgttttcatcttcctcaccttaaactctatacccattaaatgctaactccccattcactgcctctggaatcctctgttgcactttctgtctctattaatgttacaactccaggtgcctcttgtaagtggaatcagacaatatctgttcttctgtaactggcttatttcatttagcataatgtcctcaaagttcatttgtgttgcaataggtatcagcatctccttccttttaaagtctaaatagtatttctttatatttacacacatgtagacacatacaatctttacatatgtacacatataggtacacatacacttttttaaatccattcatctgttgatggacacctgagttgttcccacattttggctattgtgagaaatcctacagaatgcttattctttccgtgtgtctatgggtcacttagtaaagatgatattgcacctggccaataataagttttaaaataacattcaaaggtagaactgttattagccacattagtatataattatttggaaaaaaataaaacccctgcaaatacttagaaattaacaaatactctccttaaaaaaaaaaaaaaaagactgaagcctagtgaaaataaccagaaaaaagggcacactctcagaaaataatgcaaaaaacccaacaatgaacattgacttccttagagctcagtttaagttagacttaagcataatcttaagagtctgctatataagaaggaaaccagactggcaaaatgaccactaaaagatgaaggatctggatggtagattcagatcccctcattgtgtgttgctggagttttatttttcttcccaagtgctccatcttgcctgtaaccttagcgccttccctgggatgatgggagctccatttgaccttggtgatgaacacagacagccctaggtggcgtgagcactgctgattgataaggtgggtgtggagcttctgtccttctcagtggattgcgagaactttggctccatgtttcttcaccagggtatggggactcttggccatgagctttccttagttccctggctaatttatgacctagaggttgaacatggttgagcagcataagggtgagagaaaagcatggtactccagctacccagactgctgaatggctgtgtcttcaatttcaaaggcatggcaaggactaacccacagctgagaattaattaatgcttacagattaccttacagaagcaatctaatgataaaacacaaatgcctctgaacagctataggtaaaggcaacagtgtttttttttttcctatttaacgtagagtagaaaacatcttctaaattagcatatgcatgtaactccaataattcctcttacatgtttttaaaagttgtcttttcctgtgtaagtaatataggctcattttataaaactgaaaatattataaggtgaaggaaaaagtattacacctaccttcatcctctaaagaccagtgctgttcacatgtgatttgttcgctttggtagccaggaaggaaggtctaattatttcctagttttgcacccttgtgataataatgcatatgtatagttatcatcctctgaaaatgtgtcccttgattttctacatagaggaaaactaggcgcatcaatctggttggatgtgacagggaaagggtactagaatttatttatctagaagctgccttgcctcacaagcagtgttcacttggagggtctccatttaaagggacccctgcaaattataaggatagggagggtattaagtcccttttcaactcctaagcattaccactgcctgggaagttcactatggggatgttctgctgaacccctatcaactccagtgggggtggcagcaggttcaagatgccaaagaggagacctggagccagcgatgagacgaggggttttattggatgcttccatacaggggaatccagtggtggcaggctgaacaggagaaccacaaccacctgtaaaaggcatgcagtttatatagcattttcagttagcaccctttccctaacatccttcacctggcaactttcattccacctatgagtcagggcctggatctgccgtccatgttccatgggacaggccaggggttcagatgttcctcatagacaaggaaggagcctccaggtcggccactcccagatttcctagcttggaacagacatccgggtgcatcctccacacagagtcattttcagggtatgcataagttattgctatcaggtgcatttaccatgcaggggaattgtaaaaagagaaataaaggtctgaaaatgtgtctccaggtaaagtggctgcattttccaagaaaaagaaaaaggaggtttgtatgacagaccttatttttaatttgtgagtttatgaagcattttataatcatataaaaacaggcaaataaagttgtacttcttcactcagagtgttaatcaagtgtcttctatgttccaagccctgggaatgtgaaagagaataagaaagcaacagcctgagggacagttaccaccacccaccaagaggcaaggtgctcccctagctttaacagaccttgcaggcgaggagggctagagctcaggtggatgaggttaagtctgcatggagtgggcaggagaaagggtcaggggaaggttcagtgggtaagtaatcgccggcaccaagtccaggaagatgagggcatccccagcagagtaggtgggggatggccatccagctaaagaaaggcacagctcagagggctgtgcctcatgctgggttgtggcttcggactggagaagcaggtggagacccatcaaagaagagctctgagattttaccctctggcagagggagccattgcaagttttcatggggtgttttttgtttgtttgtttgagacagagtctcgctctgtcatccaggctagagtgcagtggtgtgatcttggctcactgcaacctctgcctcccgggttcaagcgattctcctgcctcagcctcccgagtaactgggactataggcgcctgccaccacgcctagctagtttttgtattttcagtagagacggggtctcaccatgttggccaagctggtcttgaactcctgacctcaggtgatccaccttcctcaacctcccaaagtgctgggattatgagcatgagccactgtgccaggccgattgcaagttttcatatgggtactgccccagtcagatgtgggtttgcattttagaatgaccattctggttgcaattaggacaggagatgggataaaagagaaatcagaaacatggaggccagggaagagactacttaatattcatttacgtattcattatgcaatgtttatttaaaagcccaccacgtacggcatactgttctaggctctgaggacaaagcagacaaagtagctacttgagatctgggttaaggagcagaggatagaggttggcagagtgtgggaggaggacaatgacttgcagaacttggcaactctgtcattctgatacttcaaattcattttctatacaaggaaaaaagagtaaccgattaaagtgcaattcaagaaagtgagaacctacagggaagtaccaaaatatacaacgaaacgccacagtcacacatggcagtgggggatcctggattggattttggattaaaaaaaaaaaaaggttactagaggccgggcgtggtggctcatgcttctaatccgagcactttgggaggccgaggcaggcagatcacaaggtcaggagattgagaccatcctggctaacacagtgaaaccctgtctctactaaaaatacaaaaattagctgggcgtggtggcacgcacctgtagtcccagctacttgggaggctgagtcaggagaattacttgaaaccaggaggcagaggttgcagtgagccaagatcacaccagtgcactccagcctgggtgacagagcaagattccatctcaaaaaaaaaaaaaaaaggtactagaaaaactgatgaaatctgaatacataaaatctggagtctagttaatagtcaagtatcagtgttaatttatcagttatgaccaatgttccatttttacgtaagatgtcaacattaggggaaattggatgaagggtacatgggaactctgtagtatctttgtaatagttctgtaaatctaaaattaccacccgaagtttataaatgaatacacacatatacacatacaaacctcaacctcaaccacattgagtagaaataattgtataattcatatataatgaccttatttatgtaaaaccactcaaagctgctatatagtctatgagttcatatgtatgcaaatacattaaaaacacacaccacattgtatcattcattacagctgagaatagaggtaggcatgggactttgcaggggaactgaatggaacattggctttgtccatattgtgtcacatctgtaaaaggcataccgtgagaacacccttaaaatcaaatcaaggagtcactacctgctccaggcctcagtactccctgcccctgcccggatgcagaagacactggtcccagctatgcgacgcccacctcccccccccaaacagccagccaggaagtctctttacccaggtatgaggcaagactcctgtgtgctatttacatgcccttccagagtgttgacaccaggggctcatgttctttctcatccttagctattttttccattccaactcagaggacaagaaaaaaaaacatcccactgtgaaaagaagtgtggaattacaaagaataataggaagttctcgctaactgtgaagccctgctatggagtatataatgggccttaacagctgctgcaacagtcgagactcgtggcagggtttgctttggccagaggagtgcactggatttcttatatttcttgacattaaacaacaacaaagggctgcaggctcagctgctgcagctgtggagttcccaggagttgagcacagcataatcaaggtggtctggaaacacacttgatttgcatggagtggttttgaagcatggctgagtgtatccttgggttatggtcattgcatacctcccatcccccagttcgtgaagttggaatatgctggggtccctctgaaaacccagctaggcaccaagaagccagagaggtggtgggtaattcagaagggcttgagcttcctcctggatctaaactaagccaagacactgagctttcccctgaagagggactttccccactccactttcatgctttcctcgccaagcttcctccaagccatggggtgcctttaacacacgtagagatgttgcatctagtgactttaagaaaaaccaactctgctttctgaggtcttagaaacaggtttttaaaagacttcctgttagtgttatatgtttaaaataggtctagaaagaaggtggcaaacagacccagcctatttttagcagagggctccaaacagtagcggtggaaaccagcatcagtgatactcaacagggatggtgctgaaagctgcccaaagcagtggtcttcaaacttgggtatgcgtgagaatcacctggggaggggggattgttaaagctcagattgccagcaattctccccctaccctgatttctgatacaagaggcttgggggaagcctgggaatttgcgtttttaatgagttcccagtgatgctgatactgttccagtgaatcatatcttgagaccaattagtctagagaaagcaaggcccctactggaagtgacacccaccatttccctgtgctggtggtcccatagggcctctcactctgggaacaccattcttggctgtgggtgtttcttcaaagtgaacatagctctgaggagcaggaggcaggttcagcagccacatccttaagaacataaaaagttgaagagagacagaagagagacagacgtgtgcagtgctaagctggggccctcacaatggggactggcttctttcctggggaataagtaatttcaattcagcagcaggagccaactcagctaggtcctgcctctaagacctttgtgtctgtaccaccaagtggctcaagctctctgagagagggcaagaaaatgactgagacccacccttggcagcagaagggaaagtcaccctgggataatttctgggtctagaattcagctttctgtgccgagtggcaggcagagaaacgggagggtggtgatgtttgtcccaagaggcccattcccccaccccctccttgtttcttctagaaggtctgggtgctgtgttcccaactttttctgagcagagaagggtcaagaaaagataactaacagcccggaaggcttttcctggcaggtcttcaccagcggggcctgtgtctggcagatagatgggtcagagaagcccattcttgggaagcatgattgcttcatagctcttgtagaattcccatgttcgttgctcgtcagaatgcattgtatgttaatagaatcttcaaaaaggacctgctcatctcaggtgtgcttaggagaacaagaggaaggagttttaatccatatttgggcaaaggtggtaatgagaggtgaagccagctggacttcctgggtggagtggggacttgcagaacttttcttagaagaggatggtaaaatgcaccaatcagcactctgtagctaggattgtaaaatgcaccaatcagtgctctgtagctacctagaggtttgtaaaatgcaccaatcagtgctctgtaaaaacgcaccaatctgcactctgtggctcgctagaggtttgtaaaatggaccaatcagcactctgtaaagtgggccaatcagcactctgtaaaatagaccaatcagcaggacatgggtggggacaaataagggaataaaagctggccacccccaaggcagcagcgacaacctgctcggatccccttccacaccgtggaagctttgttctttcgctcttcacagtaaatactgctgctggcagagaggggtgaagcaataatgaccacagtgacagagaagaggtgagtgtgcttggtgaccccttcccacgcagggagctgtttccagagcacttctcttctgggaggcctgtgaattttgttattaaaaaggaaacctaggccggacgtggtggctcacacctgtaatcccagcactttgggaggctgaggcgggtggatcacatcaggtaaggagttcgagattagcgtggccaacatggggaaaacccatctctactaaaaatataaaaattagccaggcatggtggcgtgtgcctgtagttccacctacttagggggctgaggtgggagaatcacttgaacctgggaggcggaggttgcagtgagccgaaattgcaccactgcattccagcctgggtgacagagtgagactctgtctcaaaaaaaaaaaaaaaaaaaaaaagaggaaaccacctattccctcagaaaaggatagagataccattcttacccattaacaacagtgtaattttattgtgatgattaatattggaattattagctttgattaactgagctccttctgtgtggcaggacatgtactttatagatgccatctcattaaaccctcggcaatgctgggaagtaagtggtgtcatctgcactttaaagatgaggcgatggaccgtgttcatactcacacagtggatcactgggaaagctaggattgcaacatatagctgtctaatccgtggagttcattctcgctacttgccagccacagggatccaatggtgagcccagtaagctgtggctcttgacctcatggggcttccaggcagcaagtagaggggtcagtggaaaagtatcagttggattaatcaagtcaagcaatgactgaaaattattttcatcagagagtatcaaacacctctttttttttttttttttttttgagatggagtcttactctgtcactcaggctagagtgcagtggagcaatcccagctcactgcaacctatgcctcccagattcaagcgattctgctgcctcagcctccagagtaacagggattacaggtgtgcgccatcacgcccagctaaattttctgtagtttttgtagagacggagtttcaccatgttggccaggctggtcttgaattcctgacctcaagtgatccgcccaccttggcctctcaaagtgctgggattacaggcatgagccaccacgcccggcccacatagtttatttttaattttcttttgtatccaattttcagttactcttaaaaatacaaacatatgtaattggtgtttagtcaacactcagtgtattttaataaacaacattttttaatcggaaaaaaaaaaaacctgtaatgccttgagtgatcctgccagatgaaccctggcgtaaagttcatgctgccttaggcaccattgccacctggtgtcagacatcggaattgcaggcttggcggcagctaaagtggcgggggtggtggggtggtggagcagggggcgggcaggacccattttgattaggagagggcaggtttcctgtcttagccacctaaaccctccaggcgctgttgagtatgtgtcaacaggtgcctgttcgtttgtaatttggtgacagctagatctgtatcagctttcttttatctgtgtgtcctgaatgattattgtgttcatgacctttcaattgttttgttataatcaaattaacgtttgaaggttctgatgataaagtgacataaatatagatgaatacttgagggtaaactctagattccacttatgccaataatagttctctttagttgcacatctacataaaaagaccaccccccatactttgaccccaactgcttctcagcctaaccctctacatgcttaagcatatgccagtaactcacgatttgcaaaactttccagactcttccttgtctgcctgctgcctttgtctgtgctgttccctctgcctggaactactctcctccacctttcccttccaaatttattcttcaaatgtcaaatcaaggtcgacaatttgtaggaaaattccataaagtaaattcagaaacgacagtgttgtatgttgtattgcagtgtctctagagaatggaagatgtggttctgaacccatttttatctctttcatagctttggccatggccagcttgctgactcattctatctcagtggtttcatccattaagtggaaataataatgtcctctgcctccagcattgaaatatatatatatatatatatatatatatatatatatatatatatatacacaaccctaatttgaggtttatatataacatatatattttatttattatatatatttaatacatagggatttaatatatgtaatatttaatatatataatggggtttaatatatataatatgtagggtttaatatatatattaatatataatacataggggtttaatatatataatacataggggtttaatatatatattatatatcatatttaggggtttcacatatataaaacccctaaattgaggtatctatatataatattgatgcatatatatttaatatataggggtttgatatatataatatttaggggttatatacatattatatatataagccccctaaatagatgtgtgtatgtgtatatatgtgtatatatgtatatgtataaaccttttctgatgagacaaagtgcttcctctgcaccatgcctagtacctagtagaagtgacagggcaggtgacactggattagtggatatatgtaaatacctggaatcttgatcaatgcatgcgcagcaaatggcttccattaccttttttgttttgtttgcagataaatatttttttgaaaaaaatatatttcgtggagttaaaaataataaaatgtccaactttgactgaactggcattattgccctccttgatccatcactgtatgtcacccgagtgctggtaagcttcctcagctgccagctgcaaagacgtggatattaggatgaaaggcgttaggcagtgatgctatttctggtgctgttactttagtcaaatctgtgttcaccaggtacccatgtgctggcacctgtgattagtgaattgctcatgggagtatgtttgcaatgtgctttctctgtgttttccaggcagttttaaatgtctctctgtttttctgactaggtagtcgatagtgacaggccagaaaggtccaagttccggctcactggaaagggagtggatcaagagcctaaaggaattttcagaatcaatgagaacacagggagcgtctccgtgacacggaccttggacagagaagtaatcgctgtttatcaagtgagtacccctctcccatgcccaccctgtgcgcagaaatgtggctttcaaagattgttttcttcccactgagctcattatttctgtgcctcatcaaacccgggactgcatggctttagggtgtttctgtgggagctgaagtggatggaattgaaccctgacagggcaacagtggggggtctttatctcatcagtagagccctccaggcctgcatcagactttgggtaccagagaccaagaagggagaccctgggggcatctcagaggaggtcagaacccttagggcaactttggctttccagagaccagcttgatgatctagagctggaagaggtataaaccccaagacctgatataattagcaagacatggtccttagggtgaaaacagttgctaaatattcagccataaaggagtagttaaattatggcagattttgcaaggcagttttctctagccatttaaaatgcttctgaagaagttgtgttatatgggagagattcaagatattgaatgaaaacaacatacagacacatatggtatcctcattaccaatggagtatttgcacatatcatgaggtgtatatgtttaacaaaaatgataaagaaaaatcagtgggttaatggttgtatttggaagtgattgattgattgattgatttggttttcttacctacttaaatgcattattgtgagtttgaagtgagaagatactataagggcgttggaggcataaagtgctggacagacatagagcagtagcatgatggtaggtagtaaagtccccaccctccagcagaacccttactgggcaatgcgctcaagggtctcaggccctgggaggatgcgggtgctttccagatgtccatctcggaagccttgccaaagccttttctgagcatttgctgggggagtcacctgtcaatgagaactgaaacgtgagccatgagtcccaacttatactcaagggggaatcaggtagttgtataaattgaatgttggtgacctcagaaatacccagttccagctggccttgacagtaaccagaggtgacctggcagctattggggtccagctcctgtaggaacaaccagcagcagactatggatagatgccctcttgtctttctgtgcccatcatgggagtctccaagaaagttctggcacaaaaaactaaggaaagatacaataaatttcataatttcttaacagagtgatcaagagctgtgggatctgatatggtttggctgtctccccaatctcatcttgaattgtagctctgagaattcacacgtgtcatgggagggacccagtgggaggtaattgagtcatgggggtgagtctttctcgtgctgttctcgtgatagtgaataagtctcatgagatctgatggttttatgaatgggagttcccctgcacatgctttcttgcccaccgtgtaagaagtccccttgttcttcctccatcttctgccatgattgtgaggcctccccagccatgtggaactgtgagttcattaaatctctgtcctttgtaaattacccagtcccgggtatgtcttcattagcagcatgagaacggactaatacagcatctgagatcctccattcaggtctcagtgctgctgcgtactgagctgtgggaccttgagcaacactcttaccctccctgatcttgggattcttgtccataaagtatgattacagctaacgcttctgaggattataaaaaatgaaattactagtttttgctaactagtaattgctaaacagctaataaaacagagcttcggttgcagcttggagcttcccatactttttaaaaactgaggccatataatattacggtagttaaaagcatggattctgcacacagccagattggctgcattcaaatcatggctatcatgtactaggtgtggaaacttgacaaattgtctgcctcaacttcttatcctggaaaatgggaaaaataataatgatgtcataggatttcataaggattaaatgagttaatacatatgaagcatttagaaaatgctggaaacatagtaagcatcatataatcttcctacatgggtgacaataatcaatgatattaaaggtgaaggaaggtaagtgaaaacccaaaggattccaagttatagcccaatctctcatgtccagcacaaactttccttgagtagtcttgagtttttactatacttttatagtctatgtcatagcatatggattgattgagcaattcattcattttacatacatttaattgagtgcttatagggtaagggacacgcttcaaggtgttcggaggatacagtagcaacaagacacactgggttccttgctttcatgtatcttttattctagttctttgtttcggaataaactggcttgaattcctctcttctgtgtgtaggtgacatggcaggaagttgtgcctggtttgtaacatggcttgttgataacaccagcacagggtcatataccctcattggaaagggtactggtatttagtgggaatgcagtttcttacacaagtacttgggttacttacgactggcagactggggcccagcccttggcagcgcactcttcaatgggctcatgagggcctactttctgatgccgtttccctccgtgcttcatgcacttcagttcggtcattgtcctgttttcatcatacccgcactgaagcttcttacagttgctgaagcttcttccttgaagaagcaagtttgaggaagagccccgatcattctgcggttctttatttttagatgatgagaactgggttactctcatgttggtctactttgggcacaggaatgttgcaatttccgttcattccaagtgcctgtttaagaataagttactattttagtagtacagctagatccatggtattcatggtagtcaacacggttgggagcaaatgtggttcttcaaagaggagaatcctgggtctccaaatcctcacattttagtttctagtcttgcaagtttaaaaaggagagagccgggtgcagcacaccaacatggctcatgtatacatatgtaacaaacctgtacgttgtgcacatgtaccatagaacttaaagtgtaataataataaaaaataataaataaataaaaataaaaatagaaaaacagagcaagaaaaaaaaagaaaaagaaaaaaaaaaaaggagagagcctgcaggtgaatgtgttgtcatcataatagcgccaatgtttctgttgtttaaagttaagtgctgctcacatgcaagtacgtgttgatgtattaacgttttccaaatccaacaagaaatattttgatctaaacctcagggatttgtatgataagaaataatctggaatacatttgtccttgggcccctgaaagtgcatcaccattgaagctcctgtttattgaacactgcatggcagatattatgctaaacactttgtataattctcttatttaatccatttcacacaagagacttaagaagtaggtgttaacaccatttcacagataagcaaatagctgttaaacaactttttcaaggtctcacagctggcatgtattggatttgggatccatatccatttcttttcagctccaaagccccacattttcaatcactaagaaacactcttcctattttatccccagctagattttatatctaatctgcaaattccttagctcctttcctaggaactctgcttaccggggctgggaagggagtttggctggctgggtgatctattactttttaaaaaccatccatttccgtgacccactgccatcttgccactcctccctgccccagcccccagaaaaacttccccagcttctgacccaaagtagcacctggcaaaataatttatctcttgcagtattggaagctgacatactaatgcaaagcctcctgaaatattactcattattatgcattttgccagcatttgagtgatatgtgaactcttcactggaataaagtactgtaaatgattcatgaatgaccaagtttatgaaattctataaaaatattagcaggtggtaatgattccctcacactgtgaatatgatctactggctgcaaatttgccaatatgggatgacgggagtggagtgggagaccatctgttaggcgagtgggggaggaagacggtgggggggcggttgggatgggctctgcaggaggtgcagggcaaaacaggaagcatggccaagaccatggtagcaggcaggtgtccttggcaggagaccttcacactgatctgttgtccagtgggagatgctcagataactgggaatgtcagagctgggtgggagaagagaggagcatatggaagaagaggcaaaactaactttattgagcatctattaagtgcccaagaattccctagatccctgacatacacagacctatgaaaatggttatcttgtcttcactgatgaattagatgagggctaaacaggttcccaagatgtatttttactattaatgttggggtgaacatgtcttgaacatttacagtgtgccaaggctccatgccaaatactcagatgatggtctcatctcatcttcataaagataaccttgatacgtctatcacactcaattctagaacaggtaactggaaccacctgtgttcctggcctcagaacatggaaaggacctcactgccaccttctgagtatttgctcacatttcatactatataacttgttcttttttgagccaatttcttggtcaagttttgaatttgtggtcaagaatgttgtcataaaattgaaatacaactggcattcagaggtatccttgctcatatattttcttttgttaatgtggctctacccctattctaacccatctgtagctccatgacaatttggcagaatacacattaaagtgaaagctgctgccgtcatgcggaaataggtgtatcataatgtcagtgcttataagacgattgggagatatagatgtacccatattagagagttatttaagtgattaacctggttataaaaacgttcatgttatgaacaaatgatgcacatattaccttgatgggattgtactacacctgattagacttgtacttggaaaggaccccagccctcactagtagggacatgctatgtaagtcttctttgtcctctactctggtctcccccattgctacctttcttagccagggttcttggtggcagtcaacaaaatcacctccaactagtttacaaaggaagagatttattaaagagtacaggtagccattaggattgcccaaagtgccaagtaacctagctgacaaggccagatgaggtggtgctacaggaaatacccacatatgaaactattctagggcaaggtttttcaacagtggcactattgaaatttgaggctgggtgattctttgttatggggggctgtcctgtgaattgtaggaggcttagcagcaccaatggcctctacccactagatgccagtaccaccaccccccacccacacacacacctaatctggacaatcagatatgtctgctgatattgccagttgtcctataaggggcaaaattgagaaccactgttagagagaagtgtcatagtccattttgtactgctgtaacaaaatatcggagcctgggtatttataaagaagagaatcgtattggctgtcatttctagaggatggacaatccaaggtcaagacaccagtaggtttggtgtcttgtaaggccattctcttcttgcaatatggtgcctggcaccttgcaccctccagaagacaggaaggctgaattctcatatggcagaaagtggaagggccaaaagacagcacctattcctgaaagccttttaaattaaggcatcaaacctacccatgagggtggaacacgcatgctctaatcacctctaaagggccccacctcccagcaccattacattggctattacattacaacaagagttttggaggtgacaggcatttcaaccatagcaaagagtcaaggtcgctgctggctcttcctgccactttgctctgatgctcacaactggatgtggcagccctgcttgggttacctaaaagagccaggtgactttgccaagctcagaacctctgatctgcaaagcacagctgtggcctcccgccactcacttccatccagtctcacgctggtgcatctgcaggaagaacctagaccgtaagcaggactctaggtgcaagagagctgggtcaacatagtttttagtttttccagctccctggtacaggaaagtccgcttgccagaggactggagtggtggttgtcatctaccacattgtgatgacatgagtgcaatttttttaattccatgggtttttggggaacaggtggcgtttggttgcatgagtaagttctttagtggtggtttgtaagattttgctgcacccatcacacgagcagtatacactgaacccagtttgtagccttttattcctcattcccttcccactcttcccccttgccaagtccccaaagtccattgtatcattcttttgcctttgcatcctcacaacttagctcctaattatgagtgagaacatatgatgtttggttttccattcctgagttacttcacttagaataatagtcttcaatcccatccaggttgttgcaaatgccattaattcactccttttgacggctgagtactattctaccatatatatatgtatgtatacacacaccacagtttctttattcactcattgattgatgggcatttgggctggtttcatatttttgcaattgcgaattgagctgctataaacatgtgtgtgcaagtatctttttcgtataatgacttcttttcctctgtgtagatactcagtagtgggactgctggagtgcagttttgttccaagtgagagcctgtcagtgagaagcttagttgcccaaaggcaggtaacaggcttacacctaggagactgtgttctcaaacctgtgatcttcacttctgtcatcattagggtcctatcaatcaataacacacatgtgacctaggcaagagccctgagtgggacaaaacaaaggatttgggttaaaagcccaggctttggagccagacctacggagggaagaatctcgactctcctatcacgtgaaccatatgaaattgccattcttacaggtgaaaaagaggtgaacattggcaatttcatggttcattctaatactctgacacctttagccagttacttctcagcctctgttttctcatttttagaatgagagtgagattacagtatcatctcctaacagtgttatcattagtgggtgtttatcactcagcccagtcacttagtaagtgttccggaattgggagccagcctgccacatatcggttttatagtttaagctccctgcaagtacaatggagttgaaagcacttgtgagggagcagctagcaggtaaacagttgaatgtcagtaactctctgtaaaagggaatcatctcactgggcagtttcaaactgtggccccagactaacagcgtcacctgggaacttgttagagatgtaaattgttaggtgctttcccaggcctgctggatcagaaactctcggggtgggtctctccatctgggttttagccagcccaccaggtcatcctgacgctcactgtagttggaggaacacaggtctaaataatcacactcttgggtattaacatcatggcagctgacctgatcactaattggccttgatgaagatgacctttgaacctgtttcgttacagttctggtggggtaacatgtgcctcaactgtgcttatttctcctggtgctccggtgtgccatttgaaagccctctccatccaattccaactcttccaaactgctttctttttgtttcattagtggcacctgagagccaggcaaatttgtcccaggcttccttgctgcatcctgcctagactttggatgactgttaaatgccatgttactgcgtgtttgcttgtttctcagccagagatgaagatgtcctcagaagattggagttggaacaggctgatgtaattcctgataggggaaattagccttggggtcggcagaaccagctttatctgccttagtagatctgtgaccttgaacaaagcatttgtggttcttgaactttgttgcccttagaatcatctggggagctttgaaaaccctgaatgcccaagctgcactccaaaccaattaaatcaggatgtctcagagtgtgaccaggtgtcagtatgtttataaaattctccaagtttttccattgtgaagccaagtttgagaaactgttgtgttactataacttgtctgtaccccagttcgttcataattaggaattaatataatgataccaaccagctaggtgtgtgtttgaatatcaagcgagacaatgcaggggtttctaacacaaaataaaagtcaaagatctcatttctcccaactgcttcactctgagcaaacatctgaggctgctttctaatgcctccttggacacaaacacttaaaaataggaattctgagaaacagaatttaataaacaaacgcttgtcttctgagtgcttgtgaaaaaataattcgaggtttgttcacagcccctccctacccctgcacctctgatcacctccacctgactttttccagttcgtctcttcgtatttccaagcacttcattttattacaacccggccttatctgtcaggtgcagctggcgaaactgaggcatgaagaggttaaacgaccttgtggaggcagctacatacctggattagactgctgagttgcttctgactgattatttatttggtccactaagcaaagctgcttcctcactcagggctatggaaacatatttttctctgaacttcattagcacaaactcctcagaagaggttcaacttgaatcttggcaggtgggagaaccccacattccttaattttctcttctccacccccacactggtctttgcacctgtggcacctggcccacactcggtacttagcacacatccatggaatgaataaatgacaggatggctacccttttttttctgttttagttgtctaactacaaccaggtctacttcatcatgctgattcttcaaattacttggcggcattttctttcccaaggtgcggaagcatcgcaatacattgggactgcaagagccttagacccattttgtccagcccagcagcccagcgaatttacagggaacaagttaaataacggggcaactgctcagactcccaggacttgagattccctggctatgacgagcattgtgagtgacactctgggaccagatccccaaatgcaggggcacggtgggggaccatccattccagctcccgccacccattagccatctatatgccttcagctatcagcataaagatatttatttttatttggtaaaaatgagaagggagaggaagaagaagtgcattagtggtgtggactggaagacagaggagcgaaagaggggatacggacaggttgtcctcctacgctgggaccctgaagtgtgttgaagacccttgggttcgagaacagaaaatgattgaagtcatgttttacgaaagactgcaagattgaaagtgaaggccagaagctaattaaattgatcacaaacgattgggtcagaacccggatgcaagcaccacagctatgggaacaggtggccaaggattacacagttggaaagagaggccccctctgacacctgtagcactgtggcatgggaagtgctggtcttcaggggtgggtcaccgtggtgacatctcccgcagtggtcctgataagggaggaggcagcagcagttggcacatggtatggaagctgacattgatcagggggcccttgtgaagccagccttgggcctcccaggaaatacctggggaataatgttgtgatgggggctgagttcctgtggagcaggttggaagctggtggtgcctatgatcagggaataaaggcaaatgtgtcccatgtcgtcatgcaatgctgggaagccagccaacctccgtgttacccatctcgattctggcctgcccactgcttcctgtttaattgaagcagatgcgtgactgctctggatatgaaatacggataacctgtgagcaaaacccccaggtaaaaagcacgtgggggagcatgctttttggccagctgagtcttctcttccagtctagagaagtggaggaaaacaggggagcatctggggaccatagagccagcgtccacgccaggcagtgcagactcggcagctccatcagaaagggattcagctcaacctgggggccgattcattcaaaggacattgatctggcacccaacttgtgttagccactatttcacagtgctggggatacagcagcaaacaaccaccaaatccctgcttcatggagctctgtcaatctacaggcattagtgagtatgtgacgatcaggtggccctaagtgctgggaatagacacggagccgataaaagatatagggtggtgggagacactgcttggtccaggaaggccctcctgggaggggccgtgagaagggaggccagatggaaagtctcctgagggcaggaatgagtgctgtccttatctctcatgtacccctgacagcttttctcaaccatggatgcttcagtcccctagcagatgcctggcagtgtctgcatatgtttttagttgtcacaactggggctgttattgccatctggtgggtcaggcatgctgctccacatcctgctgtgcacaggacagtccccacacgtccgcagggccgtgctctgcaggctccttgcatggcgttggccactcagagggtctaaaattattgcatggtttgtttgctcagtattcatcaggtttggatagtcaagaagtctgtcttcatctctggggcaccagagatgaaggaagggacactatcactgttcttgtaaagtccacacgctagctggggcaatgatttgcaacaatcgactatattatcttgtgaggagggtcatgttacaggttcagccttcggaaggacatgaggtcaaagcaaattctcaagaatgaggaatgacaggagacagagacgcggacggggcaggaagggttttgtgagaacagctgatggaagaaagcatttaatggcacctccagcggagtgcgtgcagtttagagcagacgagggtggggccatggcagggcttgactaggagcaaaggtgggactcgcatgctaaggagtgagcttagacatgatactcctgcggcgaaagggacaaatgatggaggattttaggctgaaagtgacatgatcagatttggattttacagggactgatccggttgacatgcaggggatgaatgggagacagtgagttctgtctctgggtctttgaagccagagtgacacacatcagatagatgcagttttcacccaagaagacctgggtagtgaatgggattagtccaaactcatagtgaagatattaaatataccttgggatgaaaagagtagcaggaatgcggacttgtgggaggagggcaggccataccgggcctcacagggcaggataaggtgcttggattttactctaaggaagcctcagcctcagagggttctcaggaagggagtgacatccaatttgcatttcaagaagataagatttatttgagcaagtcaacaataacattcaaattgtcatgaaatagaaattaattcaaaaatgcattcatttattgaggccccactaccaggcactggggaaaagagatcaaagagaaaactttgctttccctggagctctgccttcaagtttccctctacacatagcaaaccagaaaacctttattttttaattcacaagtagagggttggggagcattttatgcactgactcgttctccccatttagtctggcataatttccatgccaagtaaatattctctcttaaaattttaaattttgagggttttttttttcttctacgggggtttatcagtgggctctctcaaaatttattaaacacagttggccagagctgttagctgttgatttctttgattggtatctgttttaagatctttattatccagaaggcgtatcttttctcccagtgaggcattaggtagtaaaagagatcatttccgtatttttctttcttccaaaggtgcagatgtttgcataataggctcctttaagtaaaatccaccttttctggaatcatgttggaaagcctgcaggcccacgatgagggactatcttatattctttaactcaggaatcctcgttcctgtttctgcatgtgggaccaaactgagccatgttcagtgtgccagaccaaacactctgaagctggactagagtaatagcaaactggagagtcgcatcctcgttaaatgatggcttagcatgtaaaacattcgtgtgactggatagtcagtgtttgacaataagatgctgggaggagagccctgtgctcttttgaaattgattgtgtcctccttcaatggatcattaatagttggggaatccacatttaaaaggggtagacccacagcagaggtcttggtcagaggtcagaaaggctgagaaaaatgggcagctggcatttcacaattagtcgtgaatgcattttctattcctttcgagtttttattgcagaacctaatcatgaactccaccaaagtcacattagttcctgttcagtgtttcttatctcctgtgatgtgaggctctggtaattagcagggctgtttctgctcccaaataaaaaggagatatatttagaaaatggatgtgttaacccgggaaagcaggcacaggaagggctgcatgaagtatctttctcttggtgaggtaggctgcaagttgatgtggaagaagttctagatcatactgtgtgttccctgcctgaccacccccgcaagcctcttgactccctattcccaaatctggaattatttttagaaagctgtcccaggccggcacggtggctcacacctgtaatcccagcactttgggaggccgaggctggaagatcacctgaggtcaggagtttgagaccaacctggcaagagtggccaaaaccccatctctactaaaaacacaaaaattagctgggcgtggtggcaagcgcctgtagtcccagctacttgggaggctgaggcaggagaatcgtttgaacccaggaggtggaggtagtggtgagccaagatcatgccattgctctccagtctggtgacagagcgagactctgtctcaaagttatcccagaggatatcaaactgagaagacaagtatttcttgggaatgccacaatgtggatgacataattttgggtcagcccaggaaatctgggccctaagatagaaagaaaggaaaactgtgaattctgtatttggaatgtgaaccaagcatatgccgggagacatcctcgaaataccatttccattcagaatggttgctccctttgtccacatgccttcatcttcctcgggctctgaccttcgcccagctctctaaacttgagcaaatgctcagagcaagacctggtgctaggatcggaacagggaagacacatggaaatgaataaggtcacattctagataacttgcacatcacggccccatttttgtaataatccctttctccatcctccacccctatcctcacttccctcttctctatgaagaattcagtttaactgtgtaggttggatcatggcatgccggtaccctggggtgatggagagttgccttcctactgaaggtcagctactgaaagagcatctgtgcgttggcaaatctgctaggttcagggctctccgagggaatagataggagaaaaattttggattcacctttgattgtacttcctgatggagtcaggattggggtgaggagaattgcacgttaacaagcatagattgcacatggagtggctgtcctttgaggtagtgagtcccctcatggttgatgtgttccagcaggagctggtgagcaccttcaggaagagcacagagggattgttactttatgtagttacattagaagtagggggtctgcaaactgtggcctgcaggcccactccattttcacccactcattgcatattgtctgtggcctcttccaccctgcagctgcagagttgaatagttgtcagagtgtggcctgcaaagccaaaaggacttactctgcccctctacagaaaaagcctgccaaccccggactagatgaaccctggtatgggttggatgtttgtcccctccacatcttatattgaaatgcgacccccagcactggaggtggggcctggtgggaggtgattgaatcatgggggtggacccctcctgaatggttcagtgtcatccccttggcgaccgagttcttgctcagctatttcacatgagatcaggatgtttataaaagaatgtgacacagaaacagaaaaccaaataccacatgttctaacttataagtgggagctaaacaatgagaacacatggacacaaggcgggcttttcagagggtagagggtaggagaagggagaggatcaggaaacataactaatgggtgctaggcttaatacctgattgatgaaataatgtttacaacaaacccccatgacacaagtttgcctgtgtaacaagcctgcccttgtacccttgaaattaaaagtgttttcttttttttttttttttttaaaaaaaaaaaaaaaggctgggcacggtggctcatgcctgtaatctgagtgccttgggaagctgaggcgagcagatcacttgaggtcaggagttcaagaccaacctggccaacatggcgaagccctgtctctactaaaaaaacaaaaattagccaggcatgatggcgcatgcctgtaatcccagctactagggaggctgaggcaggagaatcgcttgaacctgggaggcagaagttgcagtgagccaagattgcgccagctgcactccagcctgggcaacagcaggactctgtctcaaaaaacgacaacaacaacaacaaacaaacaaaaaaaaaaaaaagtgtggcacctcccttcccccacacactttgctcttgcctttgccatgttatacgcctgcatcccctttgccttccaccatgattgtaagtttcctgagtcctccccagaagctgagcagatgccagcatcatgcttcctatacagcctgcagaaccgtgaaccaattaaacctgtctcttttataaatgacccactctcgggtatttttttatagcaatgcaagaacaacctaacacaaaccctcatatttaggaattgatagctccagcccttttatatctaattttaagagcttttgagactatcgtagtttatgccttaaaggaagcttataagtttccccttttctgggtatttccaaggaaaggcaaaaatgtgtcaccctgaaatgatgctgatgttgtctgacctagagatgaactaagtccagtctgggacaggctccccagggagcattttcatggaggtcagtgtgaacccccttttccagattggcggcagggccagctttaggtcccttgagattgtctgcatcccacttcctaagtaaacaaaataatgactagaaaagtcttttcaggaaagggaaaatgtgcaaatatacgagacaaaattgcttttctttcccagcagttttctcccttaggaccatttcacaggcctgagctaccctaggagtctgttttgcccacaggctatgcgtgaagccgacccttaccctctcacccagtgacgaccacgacaatgttgatgatcataagcagtgcttgcaggcttggctagtccttcacagatgctacgtcaccagtccttgtgctgactcaacgagtaggtggctgtattagttttctatttctgcccaaacaaattactgcaggcttggtggcttaaaacaacacaatttttatcttacagttgtttaggtcagaagtccgacatggttctcactgggctaaaaccaagctgtgggcagagctggcttcttctggaagggagcatcattctccgaccttttccaacttttgggggccacctgcattcttcagctcatgactgcttcctccatcctcaaagccagcaatggaagcagctcctttcacactgacatctttcctattctcccatccccagccctctttcctttataaggtcccttatgagtccattgggcccatctacataatccaggatcctttctttaatttaaatttatctagttcacaacattaatcttctttaccatgtaacctaacatagtcaaagtttccagacattaggaggtgggcatctctgggggccgctattctacctaccaccacactccttgtatagatgaggtaatggagagacagagtgggttaggaacttgttcaaggtcacacagtgctaagtgatggatgatcttaacctttgaccccagctattgtcatctttggaaagcagggatggataatgtggccagcacagtgtccaaggggttcccctcttctgctggcttcaaatagggtgacggccggaaggagaagtaactctggatgaacccccaggggcaaccctagattcttgctctgaaagctcataggcagtgtgtggcaacactggtgtctctgataggttttctttccagagtgggagtgccccagtcttttgcaaatcttccttttctcataaatgttacctaggtgctttgcggggatgattttcttcagaatgagtgagtgtcacaaaacagccggccacttgatttttattcctgtttggcacagtcctgggcacagagctcctttccattcgttgcttagcaagaagcaggccccaaataaccacctgccccaaggcccttttgtccactggagaggataggtgattagatggagggtaattgataacgcagggtcagtagggagagggaaaccccttgaggttggacctaggcagctccaagtccagattcctgctccagtgcaactgatgctaaacaacaacagctaggcttgactgagcaccgctggggttcaggtgtggcgtgagtgtgtttcctgaatgatcacttagaagttaagtctcccctgccatgccgggggcattgttctaggcacaagggattttagagtgaacaaaacacatttgtagccctacccccagcccctctggagcttatagtcctaaggaccttaaaggtaaagattgtttttgtccactttgcatgtggagaaactgagcttaggaaagtgtctggaaaaaggttacatggtagctgatagtgaaagaaccaaatgacaaacccacgtcctcccctccagagcccaagctccacacactgactctgttaactgcttggtttgggccgggcaccgtggctcacgcctgtaatcccagtgccttgggaggcctaagccagaggattgcttgaggccaggagttcaataccagcctgggcaacatagagattccatctctacaaagtaaacaaatagataaataaattagcacggtgtgatgttatgcacctataatcctagttacttgggaggctaaggtgggaggataacttgagcctgggagttcaaggctgcggtgaactatgattacataactgcattccagcctgggtaacagagtgagacccagtctcaaaaaagtacatacacacatatataaacaaacacttaggtttgcagggaagcaccctccaatgcacaggtcagcccctgccccagagaatgacgcaggtccgagtgccaatagtgtcactgcggagaagccccggtgtaaaatgaaaataataaaatccaccatagagcgttgctatgagttttgaaagccctattatgtgagccttcatctaaccgaatcatgttttcactgactggattttcagctggaatcgtggcatgtcagggctctgcctagccgggccccactcctaccccgacccaaaatctgagaaatgaccagtaacacggttctagaggaatttgccaatgctcattttttattctatgtggtggtgtttttttttttttttctcattgcagaagacaaattctatttccttactcctgagggaaaactaattccagcaaaggccatttgtctttggtaccttaagatctaggtaatttactgcaagtttatttttattgaaaattatgtagatattattcagaaacacaattttcaactatacggcacacttaagcacgttatattttaagtgttaatacatagactgaggatatatgctagaatgtgcatttctcaaagacacttttttcttttttgtcactcactgcattcgaggtccttaaacttgtgtgctatgaagtgctaaaggattaaaatattttcaaatggatattgtgctgtaagttttgagttgttaccatttgactgcaattgaaactcatgatgctttatatagcttagatgattaattcagaaataatttgcatttaaatgcgtttaagatatttaacttatgattccaaatgtgcctattttaagcctggtagaagtactttagtctccaaagtatgtggacgctctacttctccctagtttgtggacctgaaaaggatttagatattaatatagaataacttttccaaactagttctgaaaacataagaactgagagatagccccctgcaacacacacgcacatgcacacacacacacacacacacacacataggttttgtgctgtcttgggagcatttaagatactctgcaaactacaattgcttccttaaaatgtacagtggacgtttgacatagtaaagatattttgaagatttgcaggccagaaacctgtttaagccaacatattacacacttttaagaaagaaaagctcttaataacatcctataagaaaatcttaaccattatagaagttactctttgaataatattgtgagaaaaaatttaattagtgaaaccctaaggaagttatcagcatggagatttgtgatggatgccaatgtgccttcctaaaatgctgcaaggctattctggaaaaacagttctggagacagattctggcattaactatctctgttaacatagtggtagctaggttcttcccacttctgcttgtttcagctaagtaaaatataagggagtccagtaattcatgaatggataaacaaattgtgatacatccttgcaatggaatattatacagccataaaaaggaatagagtaggttaagccatagaaacacaagttagatgagtggcaggggtgggaaggagggcctacttataggtctgggtttccctttgaagtcatggaaatgttttggaactagacagaggtggtggttctacaacatcatgagtacactaaacatgactttaaaaatgtttcatatgtgagtttcacctcattttaaaaatcacagtgcacaaaaagaggtaagggaggccagagaaactggacaggaaaacccaggtgtgaggaccaggaggaagagggtggggcagaggggacaaggcagattcgaggggatgttccgccacattcttcagggtggcatgggcagcttttatgtagatgaaaacaattttaggaaattgcagcctaaagcggtgttcagtacacaagagaggccctcaagagaaggtcaccaagggaaggcagaagagcagcctctgcctgtctcagcaaagagctgagtgggcacccaccccatggtgatgctcacggtcacagcctagtgacccacacttgtgtctttgctgtcaagcagaagctagtgaccacgaaactaagcttaacttctggtgttctttacttgtgtaaaggatcgtaccttacatcgtagagaaggagtagaccaacactgtgtaatagacctctctgcaatgatagaagtgttccataactgcaccgtccaataaggaagccaaatagatagtagtccacgtggtgactattgagcatttgaactgcagctagtgcagctgtagaactgagttcttaattactgttttttaaatttaaatagctgcatttggctgatggccttactgttggaaagcataggttttgaatgtcacaggtgaaaactgtctttagcatcacgtgggcctatgttttaacaccaattttgcctctcccttgctatgtaatttgaggcaagttgtttaatcgtgaactttagttcctcatttgtagaaaggtagaaatgagagaatatgcttcctagagtcactgtcgagataaaatgaggtatagcatatgaagtacgtggaactgggcaaataataaatacttgataaacattatttgtgtctttgggtattgataacttatatatgtcttatgcagtggtgctttgagaaaatgaggtacagagaggtgaagtaactatgctcacgtcacatagccagaaggcagagggctaggaatttaatcccagatgttctgatgccaaagcccatttgcttgctactgcactgggtttcccttggaatcctggttaccaaattcatctcagcctgtagcattagactgggactgaggagtggatccctttttcctacaagttcgtccattaggtatgaactgttctggtctttgctgagatggtgtattagtccattttcatactgctatgaagaaatacctgagactgggtaattcatttaaaaaaaaaagagagatttagtggacttacagttccacatgtctggggaggcctcccaatcatggtggaaggaaggaacaaaggcacatcttacatggcggcaggcaagagagcgtgtgcaggggaactgccctttataaaaccatcagatcttctgagacttattcactatcacgagaacagcatgggaaagacccacccccatgattcaattacctcccaccaggtcactcccatgacatggggggattgtggagctacaattcaagatgagatttgggtcaggacacagccaaaccatatcagatgggatttcttgtaggacttgaaaccctggggaaacatgtggttgtgtgatggatttctatgtccatagtggtctttgtttcttacctaggttggttctgggtaggttctggactggattggcaggggagatcctggtctctttcatctcaggcacctaaagtcaaatctttcagaaataacatttaaccagtacctccatatgtgtttttttgtttgtttgtttgtttgtttgttttagcgttgaacacttcttgttgaatgccttctttttcattctatatgaaaatatctccaagtcatggagaactttgtctggcatggacaagggcaagacagtcttcttctgtcctgatgttagttggaaggacacatcctattctcctcacctttgggctaagagcagagtttgggtttttaatgaaaattttgtcctgacgagagataagtcaaagtcaggcattgcaaagtgccttgcatgtgctgttactggcatctcagttacattctccatgggcgcttaagaagctaacactcactgttggtcaggggactgatgctctacttcctactctaaatatagcgcctgtcttgtcacacttgctgtttaacagccttaccatgccattcttgagagaaataaagtgaggtttcattaatatgagagatcaacagtagttcagttataagttatcactgcagagggagagcagcaggttcagctcctcaagttggaaataaaaaagatgaatgggaggaggaaatgaagttagtgatctaccgcctgggcactttgtcaagggtgcgtgaggagagaggggaaagccctttctaaacacagattatacaccaaaggcaattaataattgtttaatccttctggagagccatttgttgtggtgatattcacatgactgtctttaacaccatgacaccaggagggtcttacttcgccagccaccaagctgggggcatcatgctgggtaattgtctgcaggtgcatttaactgaaacctttctctaagattctggagttcacagcacacaaagaaaataggcatagcatcattccagtctgtctactttctgtgactgaggtgatttttttctggagctaaatctgtcttttccacttgttctactctcattcactcactggctaattcaacagatacctacttggctcttactacctatcaatcactattcaaggcactcagtaacagcagtgaaccagagtttccaccctcagggaacttacagcagaagagcaggcaggtgatgagaaatgcccctgagtaaagttaaacaggaccaggaggatggggaatttgtggggggcaggggagctggaggaggtgcatgatattgtagtctatacatgatgatcagagatggcctttctgaaagggagacatttaaacagagatctgatgaaagagaaggtcatgagctatacaaatatctgtaaagagagaaagccccacaggtgtacagccagcaagatggtggaggatgcaggaggttgggtgcaggggaactgttgcaaatcgtagggccccagagtctgacaagctcaaggcaaatcctatggaaagatttttttcttttagctgctctgcctttgttggtgtacccctcatttcttttttcagcaggccgtgaccccttcttggcaaccctggaagtaggtgcaaagatccggaggtcaaagtgggcttagcatgtgtagggaacgtaggcctgggagggggtggatcactcagggccttggaaactttgcatggattctggcttctgagtgaaatgggaagcactgaaggttttggacagaggcaggatgtgttcagatatctctttcaccaggaatgctgtaaacagattggaggggaattcagtggaagtgaggagccaagctggaggttactgaaggaaaccaggtgagaaagaggagaacttggattagagagtgaggctagagtgcccatggccaaggtggaggtgataaaaagtggttggatttgcagtatgtcttgaaagaggcatcagaatttgctactggattaggtgcagtatgtgatgaaagagaggagggttgagggtagtgggaagattttttaaatatttcaacttttttaaatagtaaaaaaaaaaaaaaaaacatgactttaaatttactgtcttaatcttttttttttttttttttttttttttgagaaacaaggtttcactgtgttgtccaagctggcttctaactcctgtgctcaagtgatcctcctgtctcagtcccccaagaagctgggcctacaggtgtggacctctgtgcctagcttcttaaccatttataagtatgcagtaaagtagcattaagtccactcacattgttgtgtgacaaatctccaggacctcttcatcttgcaatagtaaaactttatacccattaaacactaattctcttcccccaaccctctgatcttagcaaccatcttctcactttctggttctgtgatcttgactgctttagatactttgaatgtgtggattcatacagtatttgtccttctatgactggcttatttcactttgcataatgcacttgaggttcatctatgtagtctcatatgacaggattttcttctttttcaagaatgcatcatagttcattgtgtggatataccacattttctttttccattatccattcatctatcagtggacatttgggttgcttccacctcttgactattgtaaattacacttcactgggtatgcaagtatctctttcagatccttcttcaaattctttcagatatgtagccaggagtgagattgctagatcatatggtaattgtctttagctttttgagaaacctccatgttgttttctataatgattgtgctattttatattctcaccaagtgtatacaagtgtgacaatttcttcatgtcttttcaatacttactctttctgtttacttgatagtggacattttaatggctttgtgcagtgacacctcattatggttttgatttgcatttcttttaggattagtgatgttcagcattttttcatatgctcattagccatttgtataacttccttggagaattatctattcaggccccttgcccattttttaatcagtttatttggatttttgttggatgaagttggggaagttctttatatttttctggattttaaccccttatccgatatatgtcttgcaaagattttctcctatttagtaagttgcgttttcattctgttgattgtttcctttgatgagcataagtttttaagtttgatgtagtttcatttgcctagttttgcttttgttgtctgtgctttttgtgtcatatataagaaatcattgtaaaatccaatgtcctgaagctttcccattatgttttccactagcagttgtatagttttaggtctcacatttaggtctttaatccattttgagctgatttttgtatacggcatgaggtaagggtctaagttcagttttgcttgtggatattcagttttccaaacaccatttggggctgctcatttcccattgtgtagtcctggcacctttgtcaaaaataattcagccatatacataagggtttatttctaggttctctattctgtttcattgagctagatatttgtcttcatgtcaatacatacaattttgattaccattgctttgtagtatgtttctaaaacaggaagtacgaggactccaggactaagagattttgctctcttgaaccaaaagatggacagattgccatttactgaggtggcaatgactgagagacacaggtactctgaagaatataaggaattttcttgtgccatatgaaagtgccgttagaaaaataggttggtcattttctgacatcaaaagattttttccccaaattgtctgagttgcagccaatataaacataggccaagtttttctaaatcagatgtgtttggagagggtggaatggctgtcagaatgggctgggcttatagggtgacatacaggtccaggcagagtgagccaaccaacatcacttgcaagattgaagaaggctcatggagttagatcagtggaagagaagatcctcatagaagaggcaaaattctctgtcttagggacaatggcaatacttgggaaaattcccagaaagtgatagttttagatgattgtcttcttggagaccgatgttggggaagactctgaggctgcttccagatgcagcaggatggagaatgactgtcagttggcaatgtccacctttggagacagacatatcagtcactttctcacttcccctgactcagctggattctcatcttctctggctcagaggggagtatcatcaagtacagctaacatctttgagcatataccatgtgtcaaaaactattcagcttttcttactctttataagaactcggtgaagtaggcactattattattttcatttgaatgttgaggaaactgcaggattgacaggttaagtagcttacctaagacatggtgagtaattggtacagccaggactggaaccctggccacttgactccagtgtccaggctattaaccaccataccgccaaagagtggcctcgtaccagggcctcgagctgcctggggcttcaggagcttctctcatctatggctgtactagtctgtttcacgctgctgataaaaacatacctgcgactgggtaatttataaagaaaatgaagtttaatgcacttacagttcctcatggctggagaggcctcacggcgatggtggaaggtgagaggcacatcttacatggcggcagggaagagagagaacttgtgcaggaaatttccctttataaaagcatcagatctcatgagacttattaactatcatgagaacagcacaggaaagacctacccccatgattcacttacctctctcacctggtctctcccacaacacatggtaattgtgggagctacatttcaagatgagatttgggtggggacacagccaaatcatatcaatggctaagactccatctctgtacagggggctgggagattcacttggcaatttttgttcctcttggcttcaaaggactcaatctaggatcatcacaaaatgtatttattgtccaaaactggagtgcttttgagagcaaaaaggactatgttaatatttaggctaggactacaaacataaaccagtcttgtccggagcaaactggaatatgaggtcattatacttatggtcagttagtaaatgagatcttagcctcagtgaaagtgaaattttactggaatgggcaacctattgaacacacactttatccagatggcttagatttggatcttttaaaagagtaacatcaccatttgaagtgttttcttcttcattaactatgaagccctttcccatatgggtttatcagcattgtaggaagggctttcatggaaccatataaattcatctctctagaaacgaagaattctaacgtccatcctcacttctgccaccaaaattagaaacatacataggtgtcgagctttctgcttggtgaaggtgcagtgacccctctttttttcagcatccatttatttctgctcgctgagctttctgtctgcattttcatctacagctctgttctttattgatagtgtttgttttagacttgtgagctccaagagggctgagactgcacactttaaatgggctttactgtgttggcacagcactttgcaaataaaggctttacaatttatttaacaaacatctagtgatggttactgtgtgtgaagcagtatacatagcacatggaagatactcaagggtatggcaaaaaggatttctatttcccataagtttatcagcagtaagaagtaacactgctaatgtctattatgtatagatgccatcttatctgtcagaaactgtgctcggtgtttaacatacattctctaagtctgtgccactgatcagtgtttctctaagtagttcccctggaacactagttcttgcaaactgttgatgaatgctatgtgtgtcattggtccccaacaccaccctcagatttggtgatttgctagaaagactcatggactctacatctagttgcatttgttgctaaggtttgttacagtgaaaagattccaagcaaaatcagcattaaaggcacataggcaatgaccaacagaaaccaggcaacagctttcaagcggagtcacacgggacacacttaattcccccagggagaaatagtgacaacgagtataaaatgctgtctaatgagggaagctcattagagacttactgcccagagtttttcctggaatctggtcacataggcaccctttgcctgataggttccaaatccctgacctccagaaggaaaaacggtgttcagcataagccatatctatttgtacggtttaggcacgttgagccactcttatcagagaatggtaggaaccttccccaaatcatcattcccaaataccagccaagagccaaccttgcaggctggcctttctagggatagcagtcccacacttgctatgttggctcttttctggatagtatgcaaaaaaaaaaaaagtttcatattcagataattttgaaaaccttaatcaaccaattttaagctgctttctttacctctggactctaaattcccagacttatctggctctctgccaccccccactgtacatcttagaagatttttgctttgtagggaacaaccacaagaagttctcgtggggaaatgacatcagtcctattcaatgtagcattaaatgctgagaaaatccatagcaggaaaggacagtttaaaaatttatgaattatcttttcctttacacttcagcattgacagataagtgttaaattgaaatactgtctcatactttgatcacagaagctaaggaaagcaagtgctgaagccgcactggcctcctttggaaagtaaaacccgagaactccatctaggcttcgagttaatagatgtggtggtctttacacacctgtagtgaaggggtcatctgttaagtaatcattagctttttcatttgaattgtaaattcaaattgtttctcaatgcagtagacttagattacataaggttagagcttaagctttgaaaagtaatttaaatttgttttcagcatgttaaagacttagtcaatttttttccttttattttagtttatttttatttttttcctgaggcagggtctcaccctgtctcccaggctggagtgcaatggtgtgatcatggctcactgcagccaagacctccctggctcaaatgattctcccacctcagtcttctgagtagcccggactacaggcacgcaccaccatacccagcttgtattttttgtagagactaggtctttccatacagcccaggctggtcttacacttttgaactcaagctatccacctgccttggcctcccaaagagctgggattgcaggtgtgaaccactgcgcctggcccaaattcctatttcttgtttgaccaggatgtcttttgtcccaaccagaattagttcttatttattgttacagtcaagatttagaatagggttttattaattatatatttggactagaatttctttattctgcaagtgcattagttttggaatcactgataaaaaccaaaagttgatttccactaacttttccaagagggagctttaaaaattcacctgtgggaaattttatgcaaaaacttgaacaagacatagtatttttctgttagcaaattataattttccccctgattcagggggggtctgtgattgttttcttccctggctgctccttccatttgcatttgcaaagatcacattcctaatcttcacctcatcagaagcctcattttgattttctgctttgctgacttctgtactccgagagattcactagctcttaatcctatcattggcctggcattcttcctcttctctatacttttccatggttcattcatctccattttattccttctagaatgtatttttttagaagcaattaccaattcttattggtttgagctatgaaatatttcttctttggttgcatcttcagtgtggttttcttctgactgtcattgtcattcacttgaacgggtgaaattaacctctgcctttgaggcccctatgtttactcttcgccggtgttgctgccagaagcttaaagctggatctaatcacttccttgctgaaaccattgatgcttctctgtcgacttcaagatgtgttcagttgggacattgccgtctgtttccttcttcagttctcctttcccttctactccagtccttacaagtgacatcttctgttcctgcatgctaaaatgcccgtgacttctctaatgcagctctctgccttggtgcctttgcgtatccatctctactgaggaactgggatgacttcagcatccggggtagatgcctggcatgaaccagaaaggatatcagattagatctgtaggtgatggtgagaatggatacaggactgtttcagtcaagtacctacctctaaacaggagggcactgtggattttaggattggagatcattggtacctgtgccatcctggggaggtgggaagaaccagttcacagatctagttttgagcaaaggaacatggggttttagcaggtcatttagtgtaagcccactagaaggaggcatgtggtgtggggtccaggacaggctgtgagtacatgttctgcaccagacataatttacatggaggcttggggagaataagcttccaggtgaggaactcagtggctgagttgcaaagagctggaaatgagagaagcaagcttaatgactttgtacgtgcttcagtttagtgcatatcccactcttgtgtcctaatccagttatttttatttctgctgaactctgtacatcctgaggatgaagcccatgctgtcaccactttttttttaattaacagtgtctgttaaacatgcatgtgattcagaattagatatcactccccaccctcatgaaatcctctttaaatacttgatttattatttattttccactagaatacttctggatttttcatgaagcctgagggaaaatgagaagttattatctacatcatttttcactgttttaatgttaatcattgatacaggaattggctttcaccatcttggagtccaccccacctataattaattataaatcctttcagtggacaaaccaataacacttctatattgaaccaggaaccagagagcctaaatgcatcccctggatatcatctagtgagtcagaggcacagaacaaaatgtgcttccaaaggacagatgattcttcaaagagagctactgttctttaaatgtcacccatgtgttagagccttttgttccgctctgtttctgcacgctccatttctgaagtccaggaagccccaggctgttgagtggaaagagtagaaaggcgagagtgagaaggcaagatgaatctggaggggaagattcatgttttctgatttctgagggtccctcctgatcagcggggtgctaatgagatcagagacaggggatgtgaacaccacgggaacctgctggctttcttccactcacagcgccagaatgttcccaccagctgggacaaagcacagggagagcatcaaggaggggatgaaaaaagagatcaggaaggaagagaatagtgtgcatgagctcacgcgtgggtgagaagaaggagaaacagaggcaggggggtacataaaaatcctaccctctagctatgtccttcaggagcgggtctatctgttgttgtttgctacttttcctatgctcttgggagcttatcagaaacttcccctagatcagcagccgcaaatcagcagcaggaagccctgtcacatgcaggtgtcattgtatcatcataaaaattacttcccagggttagtaacttaaaatgaaagtcaggctcaagggtcatcaggtagttagtagatcaagaagatttctacaatgtagtacatctcttttctcttggcttctgtgatactaagtttcctggttccgtttctgtctctcagaatacttttcccctaaaggtgtaaagttctctccttcatgtacttctctttcatgaacttctctccttctaatcttaactgagccttctccaagttccttccctatctcattatcttccatttctcattatgttccctcacaatcttaaccacacccgtagcttcacccatcactttctgcaggaaattgcctgtctaccacagaactctcccctggaatttagtgtaggcaattgtccacttgaatcatcctcaaatgtgatgtgatgtgatcttccccttggtgcatatccaaactgaactcaacacttaactcgtgccctgaattttggcaaggaagttatcaccagctttcactctttgagtgcataacctttcactctgtttcttatactcagggactgtagtgtgtgttgcagtctcttatctgactctcagaaataactttgagtagagcagtactactaaaacacaaattcaccaacttttctctgctggaccttcatgtcgttctccctgagtgagtcccttttgcaagttattaatatatgtcacacagagcctgtttctcatatttattgaccagactaaggagagaacatcgtaccctctaacccagtggttggcacgcttgagccagctcataccagctttcgtgagaccgttgttaatgtctctttctcactctgtcttcactgtagcttgatatcagccatggcaggattgtcttcaccatggcaatgggcaacaccaaggattgtcttacttcttcacagagctggtggttaagttacagcagataactgccccaccacacccattatgtcctgtgcagttatcgatgatattaactttctctgcttgaggcactctgataaaacttcactgatttatctcatttaatcccaatagctacttcatgagaaaggtgccatcattctatctgttttacaggtaaggcaaatgggcactcagagaggtaagatctgacaccgtgtgtctgagagcaggtccatgccatcgaagtagatttgtagcagaaacctggctgggggtatttttccccatattagggatatgtctgtctccaattcatgtccattctaagacaatgctactggtaactgtgatggatcagactttgcacgtttttctttcttggaacaaacaggatttggaagctttgacgttggtgttacagatcatttaccaaaaaaactgctcataagacaggcccagttttctgtttggatgatagcttctcatgatggtcctcatgtgttaattgaataatatttgaactttaaattctttctacaaatgtttgactaacaatctccccaaaatagccctattggtaaccaaccaagtagttgtttcattgcaataggagtgtaatgagagacaacagatcctaagttaatgagttatccaagacctttagttgcaaatcctttagccaaatgaccatacccatgggtgtcagagcaacagtaattgtgaattattgctatgtttaaaataaaacaattttggtctagattagattttgtttataaacctgaataaatattcagattgccactatcagaaaaaaaactcattgacccaatgagcattcaaaaaagtcatttttcctcctttttactttttcattcattaatttaatattcaaagaacacctgatttatgccagccaccgttccaagtgttgagattagagggatgaagaatataggcaagatcttagctttcacggttcacattctagttagggaagataggataaaaaataaataaaaccagaatttcggggcgtgatgagccctagggaaaggaagtgatagcagaagtatgcagtcagaggctctgctgaaacagagctgacaaggtgtttgagcagagaagcgagcgttcataaggaaccagccatgcagaggtatgcactgagacgcacccagtcgagggaacagtttggagactccagcaaccttggagtaatcaagaaatagagagttggtcgtggtggtagaagtgaaataagggagataggattgtttagtgaataaatccaagaggaaagcaggacccagatgatacagagtctcagaggttatgagttgggatttattctaagtgcacataggaagcactgtagaattccaggcaggatacagactttcccatctgtgcttaggagtctaagctgcactctttctttcttcaagtgatatgggagtgacttaaattctttgttgcaaaaccagtgacactgttatgcaaacatgaagtattgaactatatggaagtatttatctgtttaaacattgggggaagagacttttaaaatatggtttatatgctcggtggttcggtaaaggtttttctcctgctcctcatcccccagccaaccttctccaatatattcagccatggctgactttggaggataatgaaagccacaacccaggaacttcctgatggagatggaactgtttcacatcttgattgtatcctagttgggaagtcatttcatagatttgtaagatattgccattgggggaaaatgggtaaagggtatataggatctctgggcactatttcttacaactgtgtgtgaatcaacaatgatctcaaaatagaaagtgtaatgagagaaaaagctctatttaagtgttttattaggtaccagacatcatgttaagtattttacatgaattatcacgttatccttacaagaaaattgtgagttctagcattgccccattttaaagagaaggcacctgaggctcttagaaattaagggatttgcacagttacccagctggtaagtggtgaggccagaatcattccagatggtctgtctccaaagctgagattcccaacctcagccctatgggacacatgtctgttctgtcctcattctgatgggtccaatctggaggtgactgaatcctgaatgtcaggaggcagcagagggtggggccagttctagagaaggcacatcacctgtctctcctgcaggatggtctgtggccattggcgtaggccttcgttgacaagccaagcctctgacatctgaatagctacgctgagaaaggtagaccttgtctttccaccttgggaatcacagtctgatggcaggcaggggctttgtgccatcaggcaacccaaaatcagggtaccctgcaaagtcacctggcagaggtagcagggctgggtccacctagaggcagggaacattcttcttcacacaaagaggccttcccctcaccaagctgagctttttaaaagtttaatctatagcccctgagggagtgcctctttctaatccctacaaagacccttataggtcagcagtgtcctgtattgactgatccccgggatgcattggatttttaagctccgagattatcccagcttttacctcttttttaaataaatatatatatatagtatatatgtatatatgtatatatatattatacacacacacacacacacacacatatatatgtatatatatatatatctttaagttactgtgctaggcatgcctggaagtctccccacccctaatgcatttttattttaagatttgactggcattttttagattctcttgatgtgtttgctacatcttttttttctttttttttttcatttttatttatttatttttattatactttaagttttagggtacatgtgcatctttaggcaagaatttattaggatgttatggttaatataatcatggccataacttcctaatgaatgcaaatggggaaaataagattttattaaccaaagatggtgaccttaaaaccattatatcttccttgtgcttatggagaacattttaggagcacgcctattcttaaagtgaattccgttatctttcctcatgctaagaatggaagggggcttaggctgagccaagtgacatgttgcaagcagttgtatgatgtcaccaagtgctggccgttggtgtctcagccacagtgggaagctcagcacatggattaagggccaacctggggcgaaggtgattaccttcttagaagacacttggtggagatgtttttgagtgtcatgactagggaggagtgcgcctgacttctaatgtgtaggaatgctgctcagtatcctaccgttcacagcacagcctgccccccaccccaataaggaatttcctagccccaaaaatccataccatcaagaataagcgtacagagttaacatcatgggactcctgagtcagagcaacttgttttcaaatcctacctgtgtccttggatggttgaccttaattaactttctgaacctctgtgtcctctcttctaaagtgtgtctcatcattatacctattttatagggtactaagagaattgaggtattgcgtgccaaacccttagcacagcacctggcacagagtaagtactcaataaatagtggagattgtaactcttactaatctggtggtggtgtcctcctcaaagtaaaataacaaggcaaaggcttcaaatcaagctgcatttgaaaagttgcattttttggtatcaaagtcctccaagatggatttatttttctattttatgattccgtaaaaggcttcctataagacttgtttgttgggggtgggactccctctctggtgctgctagggcggggtacctgacattagtcgcacctgcagtggattcgacacattaaacctcagagcattgcgtgagtgtggctctagaaagccgcctcaactgcccaggtttcttagcgatcagtcatcttgatcaaagtaagaagcagccagtgtccaaggcaaaatctgtgtggtcgtgttgagagaaccaggcacattcgccacaagatacctgtgccttctgccattaagcaggtctgacaacgtgaaagctggctgagctgagggagttgatgagctgtcaacctcaggggctgctcagcccttcgggggtgctttgcaagcctggttgccctccaggtgtcattttgctaggggttgacagagcaggctactgcccttctgcaaatactcttaagatcatgtgagttaatacacaggacatgcttagacaggggctggcactgttctcagtgttctgttagcaattattaccattattttcacttagatttgtcattatgtacacacagctgcctgtggacatgtgcaggcacatccatgtaatatattaatataattaggaaagtgggggcattcagtactttctaggtatacacatgaacagacacacaaatatacataggacgtgcagatgtaatgggatttaatgttcccaaactcttgcagtcataaccgtctgcccagagtcaatcttagatagagagccagcaccgtgaggccaagagaatgtcttgctcctggatctggctggtgttcctgagagaaggacaagacgccgcagtgttcctttgacccaaagatggaagcaagacagataacactccgaagtgtggtagcaagccaagcaccctggagttaggggcttaaatccaggcatcaggtggttatgagtcctgtgaccctgtgcaaattagcctccccacctggggattgggaaccacagcgaagtcacggagctgctgtatggtgcataagaaagcgtatagctcactgcttagcatcatgatcgttccttaaaatgagattcagggctcatggtgccaaggtcctcttggaagcctcatgcacagagtgtcttcagacctaagattgaggaacctgtttgagaaagtttcaggtgttcttcctcaccaccatcaccatgagcaaaatggattattcactggccatatttctcctttttacctcagccaacaaggcacgcaggatcaaatgtgtggttctaccataatgactctatggacaggatcccctgtggctggcatgctgtcaccatctcctcctccttttcttttttctctgatccttgtttttatctgcttgtacttctgccttattgtgcttagttgtgcaagccaccgcaaatccagtatggattgatgtggggtataaataaatttttaaaaagttgaaccttgaatctgttcaataattctccaggattttgcttagctttactgtgctgcttccaatttcagactccctagctttgcctattggctgactgtaaccataaagataactgattcctgtaccaagcctaataagatcaattaaattccttgtaaaaatggtccctactaggggaaatgctagatgagatgctaaaactcatctgtctaaaaacaagagacaagctctttcttggattttttctttttctctttctttctttctttctttctttctttctttctttctttctttctttctttctttctttcttttttgcagctgatcagtgctcctcatgcattttgaagcttctttgcccaaggtgtctgtgacagatggctcgtgaagcagcaggaatgcacaaaacctctgctattatttttaataaaaaaatactgactctagaataaattgactattgaaaaggctgagaattcagtccttgaaactaattgtgccaagtatgggcacattataacttctccagcatggactatgtggccatgatggtaggcttggcaattaaaaagacaagtggagagatgccccaaactgccgggcctcctgctccatcctccaggtttgaactacggctggttgcaaggagtgtatttgtgcttgcattagaaaattaggaacgcctgcagaaaatggctttcccacagataaaagactattaagtctcttaaatgctggaaaatgtcttcatgagcatattcagtgatttggcacttactccacatgagaacgtccctaccatgatgtccagtaaagaatgggctacgtgtcccgcagacttgattacctccctgctccagcttggctctttctacaagggctgtgctggcccaaacatcaatgtctcatttaacttttgaaaatcgtcctcttggcatctagacctgttgttttcctggcctgctaggataaatacggaattctagggtgacttttattatgctcttttcaatattggtaataaagtggcactatgctgtggataggactgggttcacatcccaactctgccttttcctgattgagctgctgagtaactcttctgcctcctgatttgcaaaataaggatactggcttttaattcctaaggtggttctgaagatgacatgagacaatgtcagtaaaatacctagcactaagcttggcacatagttggcatagaaaaggaggagttggcagcttgattatggtcaaatctaagaagatttgatgcagacccaacttcctagggccactgaggattaaataggtatatataaattagctcaataaaagtgattatttttttcttgagacagggtctcattttgtcacccaggctgaagtacagtggcaccatctttgctcactgcagccttgacttcctgagctgaagtgagcctcccacattagccttccaagtagttgggactacaggcgtgtgccaccatgaccagctactgttgtactttttgtagagatgggattttgccatgttgcccaggctggtctgaagctcttgagctcaagtgatctgcccacctcagcctcccaaagtgctgggattacgagcatgtaccactacacttggcccataagtgattttttaaaaataagtaaatatttacaagaaattaattccctgagatcgtcaggacccaaccttgtcttcattttaagtattgtcagctcagagttctaatgaggctacaagagcattagagatagactttcaaaatattaaaagaaaaaatttcctaggcacctccaatgaaaaggatatgttccctgacctcaagaagtttccagtggccaggcacggtggctcacgcctgtaatcccagcactttgggaggctgaggcgggcgaatcacgaggtcaggagatggaggccatcctggctaacacggtgaaaccccgtctctactaaaatacaaaaaaaaaaaaaaaaaaaaattagccgggcatggtggcggctgcctgtagtcccagctacttgggaggctgaggcaggagaatggcatgaacccaggaggcggagcttgcagtgagccgagatcgcgccactgcactccagcctgggcgacggagcgagactccatctcaaaaaaaaaaaaaaaaaaaaaaaatagttcccaggcccctgttagacttcatgctccctggctttccctctctcctacaaatattagaatttgttgctcgcctgctatatgttggggcctgcatgctgtgtgttgtgaggagggcaggcaaagctcattgcccttgggatttgttacctggcaagaaagcaaacactgaaccagtaatgataagtaatgactgattttgaaggaaccatacaggcacctaggaatacagaaagggatttccttcctgagttgggggatggaggaaggtttctttgaagaagtagcatttgagcctgcttcctcgagggtgagtaggagaaaagacagtagggcttcatggacaaagagacagaatatacacaggcgaagaggagagaaagcgacggtgagcttgaaaggttcaaagaagccgagacagctgcaactcaagtagaattcatcgtattttttttcttttactaaaaatagaatgacagaataagaaatttatataaggagtattcaagcagaccccaaaggccaaagttcatggatgaggtttcctctttcctctccgctcagcttttaggtttctttctttgtcccacccatcttcgttccctgatggtaggtccatgatgtagaaagtttacaaaagaaaatgtctcagggaaaggttcctccatgaatctgttaggaagaaaaactccagtgaggctgcacaccagcagcactaatcattttattttatttgtggctgtgtagtagtattgtgtggcgtatatgtaccaccttttctttatcgtgtctaccattgatgggcatttaagttgaatccatgtctttgctattgtgaatagtgctgcaatgaacatacatgtgcatgtgtctttataatagaatgatttatattcctttgtgtatatacccagtgatgggattgctgggttgaacgctatttgtatttttaggtctttgaggaatcgccatactatcttccacaatggttaaactcatttacacttccaccaacaatgtataagcagtcctttttctctaatacctcaccagcatctgttattttttgactttttaatattagtcattctaactggtgtgagatggtatctcaatgtggtattggtttgcatttctctaatgacactgatcattttgaagaatttattcttgcatactcttggttaaatgcataaagtgataaattaaactgagtctttataagcaagtataaattagtggttatttgggggctatttctgatttacacaataacgtatactaatcacattcattaagatgagtgaagaaattgatttagctggaaagcatagctctacagaggcatagccaaagtctggctatataaaaacatttttaccaccaatattttcaggcaaatgtgccaataaaaggtatattctatgtgaaattgcagcaccctattggaaatggcctgctttaacagtcctggttcctgcttattaagatgcaccttcttaatgtatgcaataaaaattagactcaaagatatctagtgatgtttagccagcttcagtgactggtctagaaataaaaagatatgccagtaaaacccgagtgttgcaaatactgttactgatgatgatcaagaagagaggaaggcactctgtgaaagattgggtacacagtgttctgtctgatatgtggcttttttggcatcaaatgtgcactgcggaccattggcacttttcagaggtggccaacacataggtgccagggacaattaacagagacgtggtggcaaactcattaacgcaagaagagaatctgccattcagagacattaatttaacatgacaccaacaggggtgtttgtatgtgcgcgttgtggtgtcagacattctgctctaattgagttaattaaaagttaatggcacagagcacatcgtgacgctataaataacaggcacgtgaccagtccttatactctcatttgaataaacctttagctcaccatcacattccacttctgaaggattcattccacatcactgcctctccttccacctttgaagagggtgagtgctattccatttgatacataaacaaaaggaattggaaaagataaaaggaggcttgtgtgctatgtcataaatatcacccatcattgccagccttgtacttaaacttcttgctgggaagggggaaaatgtgtcctcctagccagggctgtggtaggatgtggggagagcagggaacctcctgctgctcatggtggatgggaggccggctgagggggacagtcactaagaagatgagttggaagtaagattgatataaaccttatggatgggaaagctgttttcctctctgagcttcagtttctcatctgtgaagtggagctaatgagaatctggtatccacgtcattgaatgcttctcagcatgaaatgggagaaatctctaaaacacttgacacaatgttgggcacacagcgagtcttccataaaggttagatggtgctgcttggaaagtctgtctcctgagcgtggggagaacagcccctcaggtatggctgtacccacctccctttctcagcatccttgtttgggtggccagtggagttctcgacgttcgtttttaagtgttggtttggttgattacattatgttacaaatgcatccaaaaaaggaaatgtgcgacatagtacttacatagattacaggcagagaaacacttgaaaatcattcacttaagacaaagtcaatagaagacttctcagtctcaaatttttttttattttattattatacagtaagttttagagtacatgtgcacaatgtgcaggttagttacataggtatacgtgattttgactgaggaaactcgcttcagtttgcttaaaactgaatgctgagccttctagccctgaggcaaagaggtatccatggcagcttacctacctttcatgtttccagcaccatgaaccacagcaccccttcaagtgaaagaagcaaacttctttgggggcctaaaatcatgggagaaattcagattgctcatcgtgcaaccaaatgaacatcattcttgagtgattctaacaattgaaagaggacaaaaatgcttcttacgtggctctctcggaagaatttctggtaatagtcaaagatgaggactttcaaactttttggcaggttctcacagtatataatagttttttttttttgtaaccatgtacccccaatacacacacacacacacacacacacacacacacacacacacacacacgctctctcaaaacaaagtttacaaataatacttagtctatgtggtgctttgtagtttctcttctactgtcgcttgttacttaaaatactggtcatgacctataaattgattttatgatctaaaaatgaattgtgaaacctggtttaaaaaatgctgatgcaagatgttaggtaagaacatatttctgcaaaaatacttaagtggagggacaggaatgagtggggctaggtgtccagtgttctggaaagaattaaattttttattagtatctatttctcatatttctccccagcacagtcagttctgcgtggcgcagccatcctaccaaggggagtctgtgggaaccaggacacttgattgctttttagctcagtcttcgagggagtgctggagcaactctgtgcatcggaatcacccgggatcccagcaggtctgggagggactgagattctgctcccaggtgatgctgatactgctgctccccaaagtgcgttaggccatacactgaacagcaaaggaagagaaaaatgcaaagttggaaccttgtgtttcctggcctccaccgacagccccatccagtaatgcctcctttctccttcaagggcatcttattgtctcattactcacatttagagactgattatgtcatttagtaagccttcgattgaatatttaaaagccacttggatgaagttaaaagtcagcaaagaatgtatttgaaaagcatgcatagctcatagctcctagaactgacagtgaaatggatgcaccaggtcttggggggcggccatgtatcgggggagctctgggctttggtagcaggaactggtggagatctttttatgtgaggccattggactgaagcagcatcccatgtcctttggcccttgcagtagaccctcacatttcagggaaaggatttaagaggccccttggctcacaggtccactcctcagccaaggagaacagggcatcttgactgacccaccaagactttgttatgacatagtgaccacggttcagtttccatgcaagggggcgtgcatgcggagtgggcagatacagccacagcacatgggttgctgaaaactaagtggctttgagaggaaggtaagtgcttttgctaaacaccaactctgtggaaagctcattaccgatacgttaacttcatcccctcgataagccagctgttctcaattggggatgactttacccttcaggggagaactggcagtgtctggatgaatttttggttgtcacagctgggttggggggttgggggtgctcctggcatctggtaggtaagaacatatttctgcaaaaatactgaagtggagggacaggaatgagtggggctaggtgtccagtgttctggaaagtatctattagtatctatttctcatatttctccccagcacagtcagggatgtggctcaacatcctgcaatgcccaggacagcccccatgacaaagaaattatccagtacaaatgtcactagtgccaaagctgagaagccctgcaaaaaacttgcatgatagtgacggttttctttattttcctcttttttttttttttgatgacagaaagttagataacagtcacaagatcagaaagcgaataagtggcagagcttgaacccagatctgtggggtaccaggacaccctgccttcttgctgtacctctcaatactggtctcttgtgcctgcctgccaaggaacagaggcagtgggaggagtcactcaaagagtcttatgagcctgataacaaatgtgtgagttccctccctttgctgatcagatttgttctgttccattccggagtcactgcaaactaccaggttttaattcaaccgtaacctgtgggaaggcttcacgtctgaggttacctggtgcagctgtcttcacgctggcacactgagaagttaccaaatgattaatagccgtggagtttcccaaaacatccaggtggaagacacacaactggcttattgtcttttaatattcagtcatataaattgaatataagagggtaacagcaggcacccctggagacctgggcatgaggtttagcttcatgcaatcccctgtaagtataatttccccagaccacatggggtaatgggcctccatgtctctgatttgcccatggggggaggacattaagtctgcacagctgtggtgtaatcagatgtgtagggagactctgagagccagaggaatctcttttccatgctgtctcacctgaaatgcttgtcaattaatgtagacttgtggtagacattttgtttgaaaagaagaaatttcattttctttcaaatattatatggtgcaggtgaagcacctggggtttttctaattataccgtgagccattgggaagtatgaacatattttacacattaaaagacctggattttgctggagaccctagagaatgttctcattggagtccccctcatttaccttggaaaggactgtctgaatttgaaaagaaatctgaagcaggaaaaacatataaagaaatatgaaaaaatggtataactttcaagggaaagggtttccttaaaaattcatgagatgggttataataaatgcactagaataacttgtaacaaaaataccaacagtgtttctttggcagatgtttctcaaatatttggggtggtttcaatggttttaaaagctttctcccaacgcttttatgttgcctatttggaccaccaattgagtaagaatttggctaattagtgtaaattcattaggctttagcataattatatttcaaaccaaccagctaaattgatatgatgttgtttgtcctgagaatgactaaatgactgataggaaatgggatatattctttgaaactcgatattcttagagcttggcaaaccgtctggtgttcaaatacattttgttatttgaatgaatacatattagctatggatataaacaaggagggagagatggatgggctgagtgtgattatgccagaaaaacaggagtcgagctcatcgcaagacctagcagtaatttttaggaatcaagtgatacaggtgttttcataagttctcagatgggaaacaattagtgaaagcaacaattccacctttttgtacaaaacatccttttgcttagttggttgtctgcttgctcctcaaacattcggaacatttccaggatcagtgaatatataacagcgatgttttgttttcagaaaatcaggctgatagtgttgtactgaactcaaatctgccttttaggaaatatccatttcctcctggttcttcctcttgagatatgcagagatctaccaaccacatcacagaatggaactcagatcattaaaggacagattccttgacttggttcataggaatggtcttgactcctccctagccaccgcccactgaatggtttgatataaaaaaaacaaaacaaaacaaaacttaaaatatgatcttcgtgatgtggtttggccaatgtagaggattaaaaccattaccactgcttcttctgcttatgaggcttttgactggcttcctcttttctgtcatccaggttctcaaaccccatgatgaacggtgcaggcagggagagtggcagagacagcaggctgctgccatggcctcaatcccagccacttaagttggcttcaccattttcctgcccatgtgtactacaggttgacggctagagacactgtgaacatcccactacttgccactgaggctgaattttttaaaaaaaataatgatagcagaaacacctcagacagtctttcatgcagagactcaatttaacacttcagaaaatttttgttcttatgtcaagatcctaaagttcctagatagattccaagatagaagtacccaacctattgtggctctacatccaatttccattttttattagcatgtgattttcttaacatactgccattatcataagttggacaccccattttcaaggcaactgaagtgaatcagagttatagatagcagacatagggtataaattgctgctgcccaaccctgaatacattttttttcatccagtatgatgctctcctgataaataccacctgttcaatgggaatttaagacaggttgtcattttagcagtcaaactttctgttggatcacactgagtttatggtcagcttgaactctcaaatctttgtttatgaatttttatcaatctctgacttttccaacttggtttggccaatcgctttttgaaatagaactttatatttaacttcatcaataacatatgtagaaatatatatacttatatgtggatatatacatcgtatatatgtatatatagtatttgtgtgtgtacatattatacacatgtatgtgtgtgtatatgtatatatgtatatgtgtgtgtatatatatgtatgtgtgtgtgtgtgtatacatatgtgtatatatatatatgccctttaagactaatgcaataacttttaaggttctttttgattgaagaaatatatgtaattaatatcaaatcatatctatggcttgcagcttacccctctgcctacccctaatttctaattcctagagacaacacccctctaaactcctttggctggttttttttttctggcatttgtgtatgcatttctcaatacataattatactatcatcatactattataattttcacttataaacatttatttctcctattaaaactaaagatatggctgtcaaactatgcacacatttattatccctttatattctaggtttatgttattgtggctataagaatctgctgtaaataattatatgaaatacgactctgatagaattttctttgtcacctatcattttgtttttccaggtgttaataattatttcttcatttgtttagtgttctatgtattttttattaaatcctatgccaaacattccaacagagctgtgagatacttgtcaatgtctttaaatgtctcaagtcgtctgtttgtttgttcttattttcttggaatttgtttttcttggaattctctgtatttctgctctagtttcttcctctaagcctgcttctcagccatcaccctgactggccatcaaactgggaactctgtttgcctttgtcctgtactgagtctcctctttcccaaatcctttctctttttccttcctggttaacctctggattatgtgtgtatttcgcatgcctgaaaatcctttttctacttttagacttgcaaatttggctggatatagaactctaagttgaatatatttttcaatagatgatgaacttggaagattcattatctaattttctttcagctcccttttacataactgtcttctcttaaaaatacttcgtacatttcttcaactttatcttatgaccactctgttgttgtattattgtttaatctttgccatcataatttcaattttaatggttttttttgttctctcaatgttcatttttatagtaatctttgttttgtgaatacagtatcccctcttagctcttcaagaatatcatttacaggtgtttgggttttaaagattcacctgttttctgttgcttctaaatttctgcttttttttttttttttttttttttttggtctgtgtcatgttagaagggttgttcacattctttgtgaatctttgctgccgttgtcctctgagtgaagcactaaaggctctttaggagttttgcatggacgtgcatgaaaactgatgagcctcaaaatgggtgatggggttgggactccaccatcagtatctgtagttattttcggttttttgtttatttctgttttttagatggattctcgctctgtcgcccaggctagagtgcagtggtgcaatcttggctcactgcaccctctgcctcccagcttcaagcgattctcctgcctcagcatccctagtacctgagattacaggcgcctgccaccacgtccggctaatttttgtgtttttagtagagacggggtttttaccacattggccaggctggtctcaaactcctgacctcaagtgatcaacccacctcagcctcccaaagttctgggattacatacagaagtcactctcacacacatactcatatttgccttaccatttgtgcaggaaatcaataccattactacccaagaccaaaggtttcactggatttaagcactgacatgaggccaagaccatagctccttccatggatatatggtccactttaatttttatgaattctaccctaagaagggggaaatgttaattgaaattgtagccattgttaacattgaatttatcacttaatggcagttacttattttaattataacatctgtgtccaagtcagtgtgttcattgttgtattcctcagaaagtcttatcaggaacccactcccactgtaactaacacagataaagtcttctgctggcatcatctcccctcttcacactccagggaatacctaaaaaatggaaaaggtagactgtgccctttactaactcttaaggcaaagaagtttaagtaaggacaaacattaagccaatatttccgatatggatgttaaggttcacagcacaacaaacatcacaacctgtggctgtcttttacctcattcatggaggcttatgaagtacacttttcttctggaatcctctcttttccccacctctcagggcttcttggtgaggtccacactcttcactcaccattcctggtctcaagtcgggatgtcttgtcctaactatcaatgacccacagttacctctacctctcagctgagccctcagcctattttctttttttctactcatgttctgattgcaaatgacaggagttatgactgttgttgccccagatctcatcatctacttaaacatcgtcatctgccagtattctcagccttgcttttttttctcagtgttaagaatttgttagggaggagctggtgaaatcctgaagtgcagcagagacatgcatgcctcattctttgctaaaacagaatgccttcagaagcaagtaccagaaaaccccaacccaactgttgtaaacaaagaggaaaatttatcatttcacaaaacacaaaggctgaaggtgcagggaagctccagggatggttaattccccacctccgcagcatcagggattgggttctctccctcttcctgctttatcattcagagcccggctggattatcctcaggctaattcactccatgtatgcagaatagctgtacagctaccagtgtcagaggcaggcacatcggcttataggagaaagagagagcagctctccctttctgtgtgtgcgatgatttaaatgccctctccaaaactcacgttgaaatttaattgccactgtgatgatattaagaggtaagacctctaaaaggtgattaggtcatgggggctccaccctcatgaatagatgaatgctgttatctcaggagagtgtttgttaccgcgggagtgggctcccggtaaaaggatgagttcggcccccttccccttgcaagctcactcatcatatgatgcctttcacaacattacgatggagcaaggaggcctcgcctgttgtggcccctcaatcttggacttcccaccctccaggaccatgagccaaataattttttttcattagaaatgacccagtcattttatttaacaagatattatgttgtcatagcataaaatggactaagacatcttttatcaccactttcccagaagttcccatgccccacacatgtgctctcatacctcattggccagaccaagtgaagtgtctctcagtcacaggtgagggaaatgagatgaccatgaatggcaaattaatcaagctttactcatttagagaagtttagaggaggataccttctttggccacatgactgtatgggaaatggtggacactgacacacacaggtgtatatagatacacctgcccctatgtgcaccactgacacatggatattaactcagtggtaggaccagagtaaacccctgatcatagtaattgacataattataagtgcagacattaactgtactgcagtttgtctttagaacagtggtgtatatatacctatactcatgttgtatacaaccttcacaatatgtaggagaggaacttccatggaagtatgaacagaagatcaactggacagttacgctgctggtgagctgtgtgtagcctgagggatctggcacatccttagttcttttcgcacaaatgctgctgccagttggctcaagcatttcagggcagttgccacagttgttactacagttaccacattttttccaaaccagcagtcagcatacacaattggataggtacttctttccaatctgtgaattatttgatgtcatatgagttacagaagttcatcccgggtcatgtttaaggatatataaattacatgttgtagacaaagtctacgtttctacgtttttttgacagcacaagtgacatgaagtgaaatgcacatttcaatgggtgtcgcatcctggtctcaatagttttagtgcagacattcttcctacacaaaaatgttgtgaaaatttgaattgatcataatgtgattgatgttgagaaataggatttatatagtccatgaactactattgggtataaccacttgaagctgggcacaggttcctaaggagtgagtgtctgaggacaccacagagaggccagagctgctctgctcacctacccagttcttaggttctacctggcattctttagctctctgttgttaaaggtaaactctgccacaagccaaagaccagagcagagagatgggaggcttgtcaaagaagcatgaaggtgcttttatttccttctgaccagacaacttgctcagccttagcttcagcaatcaactacatctgtaaagacgcttttactgttggtgttttaaacagaaaaacaatgacttcataatctagaactctctagaacctccttttctattacaaaagcagctgcttttctctcctagtttttggaaatgtgaggcttcttagaaattcaaatgttgtgtcataacctaacatagtttgcataattgcagagaactcaccagatgactgttgtatcttatgaggcccctccccagaactcctggagagacctaaagtggggggcagatcctatcaccacagctttgtattacaaaacttcattaaatatattatgcaatgcattactgctgtatgcatcataaatagacacaccatccttcatgtctcaaatattgattatctaaactatcccacatcatctatttggacctagggatatgaagatacaaagatgcagtctgttggcagaataaaattcttaaacagatcttagaatagtgtgagttgttcctggaaggtacagagtgccatgggaactcagagaacagattcccaccccagtaagaattctgggatcactccaccccaaaagaatgagggttatgttgtccttagtgggaggtggtagttgtggattaggtcctatcatttcacacactgaccatctctgcccagtaccctgaatgagtgctccatgacatcatcctctttgacctctggccaccttcccttctcctagccttgctcctcaccaggtaatcctagacatatggacagctcactatcaagaggaggattggtccactggagaaccgttaatcccttctgcactttggggatgatctcatctgatttgtctgtcctgcttcctcaaagcccctaaaatgcatttctatgctaagttaaacagaattgattgcggctagatttactgagtcttttgaaatggttctattattttgaatgtaagaaaataatgtactacacctcctgagaaatagatcttctgcaacattttcattaatctctttattaaatgtaactggtttctctttggaaattaattactgaagtagtattgagaattttaatttccacaatataccagcaagagatactgctgtttctttatacactgttacacagcagggcaataatctattgaaataagcccaaaaagggggcagcttgtaattaaaacagtataacacgagtgtttgatgactctcttagtgctaaaatggccctgtcatgctgtgtttgggtggaataaaatgtatatttaggaaacagctctatatggagaagtcgacagactcaggttttacagtctgggatgtggctgtgtttcactgcaataatatgcccacgaggaaatacggtttgtttttggcatctgagaattacaaccattgctgcacaataggaagcttcttcccttagtaagccacccccattgtgaaatttaaaatatttaaatgatgaagcagagagcatcaattatcaatgtcggtatccatggaaaagacatgagtatgcaaacacctgagtgcacgcacagctcacgtgtaggtgcaagtccacgaatggatgcggatcctgtatgtgtgcatgaaggccctcattgacacagattcagcactcaataactctccctcacgcttagaggaggcttcatatttttcaagacacgttcctatctgtcatcttctatcctcccagacgtgttttctcatgataagaattatttacacatcatttacatttacagatttgctttttttgttgttagtgtcaaagacatttttgcagatgctgtgttgctcttctcttttctccttcctcactctcttctttcctgccttccctccctccctcccttcctccctcctttccttcctccctcactcctttcctttctctttcccttcctccctccctcctttcttcctccctctctccttcccttcttttctccctctctcattcccttcctccccctcactctaagtgctaagtatacagccatgaacaccaccagctccctgcttttagggagcccaaagtcctgcccactcagcatataaaatcctataattgcctcttcttggaaagcagtttattggttttgaccactgatacatgtacctttgaggtctatgccctatccccagaagctcctcaaagaaaacagtacaactgaatcacatattgtatcctttctggatgaagtctgttaactaaaacttgctcatcttcttgtatttccagtaatgtgggtgagtcttacggataagtgatcagggcagatcccaggctggacttctccttatcctggcttaaggccaccagcaacattcttgtgttggatctagacaccagctctaccgcacattgaggcagagttcataaaaaaaaaaaaaaaaaaaaaaaaaaaaaattcatggttgctgttagagccccaatcctgcataatgggcttttatttaaaaaaaaacaaaacaaaacaacaacaacaaaaaaaaacgctgtacctagaagtaactgtccagaaaagaataatataatgcatacccaagatcataaatactggaaatcatacaaccgctggtttctcaattacagtaagaaaataattcacaatactcaaggggaaggtagcacttgtgagccagcattatttatagaaacctttcttttatctttctttgcaaagtcttttactagaattatttatttaggataattagagaaaaattctgtaatttcaagtaaatattaactacaaatcaattccagtaaaaatgctgctgtccaatcatctgtgtcactgcacttgggagaaaacaatttatgttcaagcctctttagctggattaatctcttcaaacctaagtgatccatatgaagatcttgtcaccggaaattacttttgatccaatacatctcacatatcataatggtaataaacatttgtcttgtgccttacagcttaaaaagtgtttttcatccattatctctcttaattttcatattgatttttagaaaattaatttgttcaaccagtgtttgggtgcttcttgtttgtttattccacaaaaatttatggagtacctctctcagtcctcaccactggggatgcaatggcaaataagatgaagtctccagccataaagaaactatattctagtgagggagatggatgataaaattaaaaattgtgcaagtgcatgatccagtgtcagggaatgataagacctgtgtagaattaagaggccaggggttagatctggacaagaaatgcttgttcttgctacataaagagttaaaggctgagcatccctgagtaatgtgagactgtgaaccaggaggacagcgttccaggcagagtgaatatttggatcatgcctcacatatcgtactgcagttagcacttactacttaataccacacgggtattttcccatgttgttcaaacttgaatttttaaagtctgaaaaatattccatttatggatgtccttatagatttatagatatccagcgttgcagtccggggctcatcaaattttttccactccttactgagcttcagacccaccaggctgcagagagacatctctagcaaatcataatcatttgcgttaataggtctgtgtggcccctgaagatttcataaggtggaaaaactactcccaattcatggggattgggctggacacacttcagtagctttccttgaaaactggaggaaaggcagagctgtggcagagtcaacgtgggaaatgtggtctgttgagtggtcctaggagtttcaagaacaactattctgtgcagatcagtcagccctgtggggattttagacgtggattgtactctgagagctaatgatgagtttgctggaaataatttttccatttccatttctaattgttaatatagtacagtgagctcggtaagcacaatctgctcagataacccaatctgcagtgtgactggtgcctgtggctggtgcctacacaacaggcttttgtttcgtaacttcagcacttgttgtggggggaagcaccacaaagctgctatccattgagcagtctttcaccctagttttggtgcatatcacttctttaatcaagcaaaatggctctaaaataatatcaatttttttttcttttttaaacttttaggtgcaggggatacatgtgcaggtttgttacgtgtataaattgcatgtcacagaggtttggtgtacagacgattttgtcatccacgtactaagcataatacccaataggtagtttttttcaatcctctcccacccccaacccttcaccctcaagtaggccctggggtcttttgttcccgtcttagtgtctatgagtgagtactcatagacatagtagtgtctattagctcccacttataagtgagaacaagggcatttgcttttttcttcctgcaagttcccataggtggcagctggataaagaaaatgtggtacatacacaccatggaatactatgaagccacaaaaaagaacgagatcatgtccttcatggcaacatggatggagctgtggaccattatcctaaacaatatgaattcttaagaagccaacagggaggcccatttaaaagcagccacaaaggggtacataaaagtgaagacaggttttaatgacataggtttcaagttaactactgtttgttgatctcttgtggtttccgtgggaggggcatttcaatactacataggtatcgtgtttttattttcgtaactacgcagcgaggtaagtttagttatctccacaagcaacatgtaagaaaattgaggctcagaggggtgaaaaggccacccttgatcaaacagttggtactgaacctggtttctagcctcacatgcaggacctcagagctcttaatgattcacccatactagtctatcataggcggcagtgcaggttttgcctctgaccacattgcttacactttccatcttcctctccaccacttacctggggttaagctctcttccagcctgcactatgacaacagcctcttcaagccaatcttacaccctctcgccttcccccaggccaggccgtctcctccatcccaacaccaaggtccctcaaaggaaagaccagtgaagtctcaaccctgcttaaaagcctcagtgacaaccattctgctgggtgggattgctggcaggaaggtggccttagggaaaggctggtttcagccaaggctggaggtggagagaatgttctagaaagcactggttgctggaagggtttgtggatcagagacctctcagttagctcaggcccttggtacatgctcttctctctgtttataatgttcttcctgccactcattatttggctcctaccctgagtgatcccttgcctccctcacctgctagagaccctctgccacaggcttcagttagttattccagcctcctgaaagcacttaccacagtttgaacttacctttgtgaggttatctgattagtgtctttagagctctctaagtaatgtattccttcaagaaagggattctgtctttccccccagagaaacccccacatgcagcacagagcctgatgtgtgaaacttgctgaatgagttgaaaataataagctaatgattttataaattcatttaaaggatcctcagcttctactgcaatggttctcaaacacctggtggcagggggggtgtttattaaatatgcacattcttgggccccacgccagatctactactaagaacctccatgggtgtgaactataatttgtaagcaaaatgtataagcaagctcccaggatgaattttgatttggataagagtttggggacttccttcttagcacacaaaatccagtctttattccatttaggtgtgttcaaatggtgtcatctcagtgagccctcctctgcccctcttatttaaaattccatacttccagccctgtctgacccggcactccctatagacacatgctttatttttatccagagaacttgtctgtcacttcccactattatacatgagggcagggatcgttggtcactcctactatattcccatttcctagaacagtgcctggtacacattagacatccaatacatgtttgaattaatgccaagtttgccccatagagcatttatgatgttcaaggccttaagcagctgggaaaggagagatgctgggccacataacttgagataatattgacattcttttttgctatttttcttttttccttttgattagatgacacttgagaaattaggtcagccatcatactttctgtccaaatggctgttgggtcatgtccacctaatagaaaggcaattttggctgctaatttcctgtctgatcagattaattgaattcagacagtgagcacagagccccctttcagagtaaagaagacagcactgacattagtgctcatgcaggcttcttagtttttctctgatgaggagctgtgttttatttccttgatcttggaattactgagagagatggagaagatgcaggggagctcagaaagcgtgtataggaggggcttaaggagggggcaccattttcctcctggcattagtaaaacctcaggagtgagccttatgactctggcttggaagataagggggggcctgctttgtcacttgtgactacaggattaatgacttggttatacgtcatttctgaacccatagtgtctgtcgcccactttatgggaattaaaccttccattcagagcaaataagttccccggatgccgggcacagtgggtagcggtgcagggaaggaaagaggggtgagggaagggtcacaaatgagccatgaaaactgccctgaagagcttacaaactaatgaagcactttcgtttttatgctttatgttctataatagaaaaaatcgaggtggcttataatgaagactacagattaatgatggtcatttaaacaattataacagaaggaaaaaatgtacaaggaaaggagttaattagaacctgaacacctaggccaagactgatttacaggatcatagcacatcaggattgaacaggcttatgaggagcactcagttcaaactcgccccacactctcaggctgttgtccgaatcctttcaagggacagcccaatccatcccaatcactccaactctgagaacttctgcttgatatatttcatttatcaagctgatatctgtttttccctttggtcctagccctatccattaggagccccccaagagcagccctatcattctacaagatggcccctcattgaataagttgagggtttcctcttgttctctgtcttctcttcacctgtgtctttggtgtttcccatatgacttgcaagcaccttgagccagtgattgcctctcaaacacctttgagttgcagaatgtatgagttcattttcaccctgctaattaaaatatacccaggactgggcaatttacaaaagaaagaggtttaatagtcttacagtttcccatggctggggaggcctcacagtcatggcagaagacaagagcatgtcacatcttgggccaggcgtggtggctcgcgcctgtaatcccagcactttgggaggccaagtcgggaggatcacgagttcgggagatcgagaccatcctggctaacacggtgaaaccctgtctctactaaaaatacaaaaaaattaccttggcatggtgacaggcacctgtagccacagctactcgggaggctgaggcagaagaatggcatgaacatgggaggtggagcctacaggagccaagatcaggccactgcactccagcctgggtgacagagtgagactccatctcaaaaaacaacaaacaaaagcatgtcacatcttacgtagatgttggcaggcagagagagtatgtgcaggggaactcccccttataaaaccattagatctcatgagacttacaatcatgagaacaacatgggaaagacctgcccccataatacaattaccccccaccaggtctctccaacaacatgtgggagttcaagatgaaatttgggtggcaacacagccaaatcatatcacagaactaccacaatacctgttacaaaatgggcactcaataaatactggataggtggattcattggtacctgtcttcttaaaagaagaaaggcaggataatcaatgagaggttttctcactcatggttatgaccttgcatttggatggaaagtcatctacaaatatgttttcaccttctcagggcaggctgaacaaagcctgtctgaaggttgtcagataactatgttctccaaagtatggggagtttattaaaaactcagatgcctaaaccatactccgaacctactgaataaggatctctttctgtggggcccagggaatctgcattttaacagattcctaggtacaattcagtttgggaatcctacaaaggctttaaaagggcaaagatttcttaaagtgtgatcagtgagaatccctgagactttttcaggggcttcatgaggtcaagactattttcataaaaatactgaggtgttttgtgcgttcatccctctcatatctcatgtatatatcatggagcttccagaggcttcctggtgtacatcattgaaccagactcaaagtagcagataagagaatccagcggattcccttaagtcaaacgtgaaagccctgcaatagccactctttctactatattttcttttgtttaggaaaatacagtttttaatttaaaaatatttttatgttaaaaagctatgagtttatttttttagtaatttggtaatctttttaggttttgtagaaatataaaggatcctgaaaccaaaaaatttgagaagtttgtttgctattgggcaacaaactaaataaatgtatttaaaaagtagatttcctatctttattcagtgaaatgctatatcaagtagttgatcccatgtcaacttaatttgttaaaattatgatttctattgataaaaggtctcatagttcctattctccaagaaggccaaggtgtttttgcagtattgcagcatgagcaggaatcaggcgctaagtattgctttcctttaaaaaaaaatgcattatatttcccagatttctggcaaatttgcagttattcaattttaagtagcgggaaccaaatccatctggatttttaaaaagtacaaccccaggaattttgtgatcatagatatgactcctttatctctcattcccaaagcttaaaccagatccagcttaaagtcatctgattttcttttagctcttccccattcaccatgggctccttaaaccaaagataccttctaagcaaaaggcaccttctaagctccaagacaaccctctgaaatggggaaaggtagcagtattgtggtaaaggtttaatgaatggcttggaggacgtgcaaagccaagccctgacttgccagtttccatggtgtgaagaatcccgttatagttggttttgagttgaagctatcaacccggcatcactaaacacggtaatgggaagggaaacatacaacaggctctggaggagacagcaagaaaaactgtctaaatccgttctctctttcaaccatccagagtttactctggatcctggcaatgccggttgaggtggcattattccagggtagtctttcatatgtcagcagagaagagaaggatacaagtgtggccaaatatgttagaggctggagcaaactccttgagagcatctgattcgcattctgtgaagaacctgtattcatagcaagaaatgaggctgaaaagagaagcagtgaatttagaacatgactaccttgcctggagaggggaaagggcaggatgttgaaccttagtctcataatcagtcttatcagaataacaatagccagcatgctaagcctggatagaaatacagaaagcacacagcactctgcctgccttatactgtagtagtgacatctttcctttttatttatttattttttattgtaatgggtgctcttttgggaagaatgaatcaactacttttgtgcaggttcgtctcattttaacttttttttttttcattttgtgaatttgaattgaatatttagtcacaggaaatagttttaagttctctgggaggccaaaggtaagaattccatgtcatagatacaaacgagtctaatatcagggctagatttattctgattaaatcattgtaagtcagctgtttttatagatctgaagtagaagagaaagtaaatatttcatccccgaggatttgttagtagagatttacatgcctccattccactcttgagtttgaatttaaaatagtcacaatgccgaggggctcctggatgcacgcacaaagtaattgttttacaattctgttagacaaaacccatagcacaatagctgcaatgcaagtgtcagaggttagggggaacattaaaatcattcaaacgctgcacatatctgccgcattctggaaaccgctgctaaaaatgggtattaaatctcaccttaaaggtcaggggcaatttacccatctttattaatgagtcgaaattatcctggaaggaaccggctattaaatatgtggagttgagacaatcggctatacatctgggaaaaacatcattagcttcctctctcacaacatgtagtgacacacatttctagatggatatgagatctaaaagtgagaagcaaaccataaaacatacctaaagataatataggcgtagctcagagatatcaaaggttgatttcagaccaccacaatcaaaggaatatcacaatgaagtgagtcacatgatttttttttttgcttttccagtacatatagaagctccatttatactatactgcaatgtagtaagtatgcaatagtttcatgtctgaaaaatgtacataccttaattaaaaatacgttataactaagaaagtgctaacaaacatctgaatctttttgctggtaaagagtcttgccgcaatgttgatggctgcagattgatcagggtggtggttgctgaaggatagtatgcagggtactgcagcagttttttaaaataagacaacaatgaagtttgtaacatcaaacaaggatttcttttccaaaatctttctctgtagcatgtgatgctatttgatagcattttacctactgcagaacttgttccaaaattggagtcagtcttctcaaaccctgctgctgctttgtcgactaaatttctgtaatattctaaactcttttttgtcatttcaactatgttcatagtagctttaccaggagtaggttccatcttgagaaatgtctttctttgcttatccataagagcaattcttcatccattcatgttttatgatgagatggcaggaattcattcacatcttcaagccacacttctaattctagctctcgtactgtttccatcacatctgcagttccttcttccactgaagtcttgagcccctcaaagtcatccatgagggttggaatcaacttcttccaaacccctgttaatgttgatattttggcctcttatcatgaaccaagaatgttcttaatggcatctagaacagtaaattctttcccgaaggttttcagtttactttgcccagatccatcaaagaaatcatatgccagctatggcctacaaaatgtatttcgtatctcataagctatagttttacaaaatgtcttttgaaagtcaaaattactccttgatccatgagttgaaaaatagatgttgtgttaccatacacaaaaacattactcttggacatttccgtcagagctcttgggtcactaggtatattgtcaatgagcagtaacattttgaaatgaacctttttttcctgagcagtaagtctgagcagtgggctcaaaatattcagtaaactatggtgttaacagatgtgctgtcatccagattttgttattccatttatagagcaagattaaatttcagaatggccaataagcatttgcttcaattttaccccctaaccagagagtctgcctattctttgaagttttgaagccaggcattgacttaatctctagctatgaaagtcctacacggcatcttctttcaattgaaggctgtctcatctacactgaaaatgtattgtttagtgtagccactttcatcaacgatcttagctggatcttctggatatcttgctgcagcttctatatcagcactcgctgcttcgcctagcactatgttatagggatggcttctttccttaaacctcatgaaccaacctccgttaggttcagacttttcttctgcagattattcacctctctcagcctttatagcactgaagagagagcactttggtctggattaggctttaccttaagtgaatgttgtgagtagtttgatcttttatccagaccactcaaactttctccacatcagcaataaggcagtttcacttccttgccattcatgtgtttactggggtagcaagttttgtttccttcaagaacttttcctttgcattcataattcagctgtttggtacaagaggtctggctttcagctatctcagctttcaacatgtcttcgtcattaagcttaatcagtctaggctgagtggtggctgacacctgtaatccccgcattttggtaggctgaggtgtgcagatcacttgaggtcaggagttcgagaccagcctggccaacatagtaaaacctcatctgtgcttaaaaaaaaaaaaaaacgtagccaagcgtggtggcgcgcacctgtaatcccagctactcgggaggctgaggcaggagaattgcttgaacccaagaagcaaaggttgcagtgagccgagattgcaccactgcattctaacctcggcaacagagcgggactccgtttctaaataaataaataaataaaattttagggaaagcttaatcagtgtagcttttgatttaaagtgagggccatgtgtctcttcttttcacttgaacacttagagaccattgtagtggtattcattggcttaatttaaatattgtgatatctcagggaatagggagtcccaaggagagggagagagatgggggaatggctgctcattgcagcagtcagagcatacaccacatttatcaattacatttgccatcttttgtcttctgcggacatggctcatggtaccccaaaacagatacaatagtaacatcaaagatcactgatctcagatcatcataagagacataataataatgaaaaatgttaaaatattgccagaattaccaaaatatgataccaaaacacaaagtgagaatatgttgatagacatgctcaacgcagggttgccacaaacattcgatttgtaaaaaacacaatagctgaaaagtagaataaaagcaaagcacaataaaatgacaatgacttatctgtgaataggagaagctaaaaatgtaacgttggaccagagagggctagtaagcaaggctccaacccaaaaaatagtaaataaaaatataagtcactaaaacccctgtctatttgggagatcataaggttataaaacaagtgacaacaggacagaaaaattttgcaacatacatgccagacagttactgtccttagtgtaaaaagagctcctgtaaatcaacaagaaagagacaaataggaaatggaagaaagttggcaaagaaataagttcttccagtgccttgagagaataagttttcctttccagcaaacctggacaccttaggggcttctgaacacattgcattgcttcctcattcagggctgctgatgggtggattttcatcaaagcatattttcatcctgttattctattgagcaattgacctctgtgggtctccatggttgataggctaacatgtaacctcatcatggtatttgatatttaattaaatgagataatttgtataatgctctagtacagttttaggccatggtaaactccgaattaattctgttcttcactccttatttatagcattgctgagaaaattaggtgagattctgtatttagaagaagaaaagttcccacttaatgatggggctgctcaataaatgttggtcctcttctctagaaaccctgactcattcagcacaatcccttagatcttcacagatttttaaatctttaattagggctcctccatcctggctgaatgtttgaattacctgtggagttactggatgataccaatggccaggccctaccccagacaagttgaatatgaactccgagtgtgggacccaatgtattttaaaaagttccacagaatggctgggtacggtggcttactcctgtaatcctagcaatttgggtggccgaggagggtggattgcttgaggctgggaattcaagaccagcctggccaacatggtgaaaccctgtctctactaaaattacaaaaattagctgggcgtggtggtgcacacctgtaatcccaactacttgggaggctgagacatgagaatcacttgaacccaggaggtggagtttgcagtgagccaagattgcgctactgcactccagcctgggcaacagggctagactccatctcagaaacaaaaatttccacaggagattgtaatgtgcagccaggggcaatatctacctgaaatgtcctttagtgttcttacagtggtgcctttatccctgaggtgccttttcccttccaccttgccatcatcggcctctctgtgtattaaggtcttagtttgagctggaaataaccttctttttggaacccctgcagcatttacatcctttggtcttagaatagccttttttggtaataatatctacttgtaataatatctttatatccagagttgtaagctcctggaggctggggatataattttattaatcattacatttttgtaatgtgtgtttcagcatttgacacatagcaagttctcaaaaactgttgaataaataaatgaatgtaagtgaatgaggatagacatgtatctttacacaagcctagagccaaaccattctctgtgagatctgaaaccaagcccctgtagtctgtgtgttatcaaacacagtagttagcttcacagacagccttattaactaactcatcccgcagttttcaaagagcatgtatttcttgtcattcatgaagttgttagttctggggaagtgttggactttggtaaacaccctctctttcggcttctcacttggattttcaatcctgagcaaagagaccactcaggagaagaatctgagtagtcaaagcagagagttggtactagatggcgctggacttactagctgtttgactttgagcaaattgcctgttagaccataaaatccttatctgaaaaatgagatacgatactaccacctgtttcacaggtaaaagtaaaatgagaccactcattaaaatatatttactctagtgccagctacttagtgaactctcaaaaaatgatggactccaggaaataaaaattagattaagattaaagagtacaggctactgtgaaaagaattgagcattttttagtggaaggagggaggaaactaacatttcctaactaccagccgtgtctgaggctgagaacttctctggtcaactcagtgcagaaaaaaatggcaaagtgtttaaatatattacataacataacatagcgtaatataataatatagtaaatataagtatagtgaatataattactttgattacataagtatgattagtaataaatgatagatataaaatagtgttaatataatacaaaatactatagtataatacaatataatgtgtatgtttctttttaaaaccttttcagtatacgttgaaggaaacaaagacccaagtttaatagggaaatgatttttgtaataaagtgaacaaactggataggttctcttgagctggttacagctgttttctgactgaattttaattataaaagatctagccagcttctatacacactctccctgcacaaatgttaactctggttcagacaccttttctgcacccagttattctcactcataatttctttctccttgggtttttgttttattttggaacggctttttaaccttcagaagtacattttgtctggaggaccagagtatcgatgtgatcctacctgtagattcttggcaagagagaaaatgttcttattaatgcagaaagtcctacccagaaggaagaaaacgtctcacctagaaaaaagtcattatgtagttttttctgggctcatggtttcctgaagagacctggtcctagtcaatttctccttggtattttattatttttgtccatttgaggtgaaatccggaggaagtaattatgaggttgttttaggggcacaggtggcattttcatggattggctgagctgactgcctgcagttgatttggggatggggtctactttagggtttcactgagtacaggtggtcacagatatccacaggttccaaccagtgatggaaaatattcagggaaaaaaaaacagtaaaaataacaccataaccataaaaaaagcaatgtaataactatttacatagcatttacattgtattagctatcatatataagtaatctagagatgatttcaagtatacagtggatgttggaagggtgttcataggttgcatgccgatactttgccgctttatataagagacttgagcattccaggattttggtgtttgtgggggagggatgttgaaaccaatatctgcgggtaccaagggacaattgtaactggattctagagcacattctgagtttgttggcagttttattaatcatatttgtattaaaatgcataacgaattatagaggaaaaaaaataaactctactcattgtggccaggcatcacagagaagtgggacaagggtgtggaccaaagaaacagaccaaggagcgtgggcgaactggagggttcctgcccatgtcctgcccactttctgttccaggtttcagaggagcaaagagccgttgcccaagaaataatggctcagccatctttaccctgtctcaaatgcaagtctctaaatttgttcctcctccttgtctggcaagtctgagcaacgttcctgcttcagctctctccccagtgtttgaggcatgaactggattccaggtgatgacttacccaaacacctcaaggagtttcgcctctaggacctgggtggaccttcactcttcccacatcagccccaggcagacctctctgcacgatgccagttgcatccatattacagctgacatttgcagttgactttactttgacaaatatttttccatttttatggtgaacccaaagagttctatcctcagggcatctgctagcccctgtggtatgtttgtgtagaatttaaaaggcatgctccctctggtcagaggcagctttacagatgtacaaatttgggtgatagaagtttccgttgtcaaatttaaaaatatatcctattcttcacacctgtaatcccagcactttgggaggccaaggcagacggattgcctgagctcaggagttcaagaccagccttggcaacacagtgaaaccctgtctctactaaaatataaaaaattagccaggcatggcagcatgcgctggtagtcccagctacttggggggctgaggcaggagaattacctgaacctgggaggtggaggttgcagtgaaccaagatggtactactgtattccagcctgggcaacaaagtgcgactctgtctcaaaaaaaaaaaaatgtatatatatatatttatatatatatacacacacacatataaatatatttacatctatctatctatctatctagatatatacctcatattcttgtgagtggactgaggctcatgccatgtggaaagtgaagcaagggctggatatttgattcctacttgtccccctgccatgcccgtgctcctatgtgtattataacctgtaccccatagatggttcttgagattactcctcctttcatctggaagataatgttcatcttttttagggccaccttcatgagcgcatgctgaaggtacccatgtaaaaaggccataaatgtttgaaaagccttcaggtactttataggccatgttcattctgcaaatgtcagtggaatgttcaggaagtccaacgtagagaaaggcccaggatggctagaatgaaatcagagatatccagtaggacctgatcactggcagaacccagactggggccagctgatgaagccagagaggcattcgcttcagggaccaaaactttcattcagtaagagcgggggtcctcaaccacgggccacaggccagtactagcctatgacctgttaggaacctggctgcccagcaggaggtaagtagcaggcaagcaagcaagccaagcttcatctgtatttacagccactccccatcgcttgcactactgcctgagctccacctcctgtcagatcaggggcagcattagattctcatacgagcatgaaccttattgcaaactgtgtgtgcaagggatctaggttgcatgctccttatgagaatctaatgcctgatggtctgtcactgtctcccatcacccccggatgggtccctctagttgcaggaaaccaagctcagggctctcactgattctacattatgatgacttatataattatttcatgatgtattataatgtaataataatagaaataaagtgcaccataaatttaatgtgcttgaatcatccccaagtcatcccctcacctcctcctggtccatgaaaaaattgtcttccatggaaccagtccctggcaccaaataggtttgggacctctgatcaagagtgatagcattgtaatgtaacatttttgaaactcaaaattaatgcatagaagtccatgagaagtaaaatgttaaagacaggatcaaaatcaatgcagaaaatccataatgagcaaaatatgaacatgttttaaaaagagggcatcagtattactgatttctttcgtttgactcaggctccagtacagcttatgttggcactgtgatgtatcctgtctgtatttaaaatttttaggtagtgtccatcatgacctttttgcagtaattgcgatttttaaaaatattgcgttaaaatagtacatatcttgattactgagttttttggtgcctcctttgagatggtgcagaaagcaagctcctcactcatctcctctagcccagccccaatagctaactcactcttagcgcctgtccttgagtgctgtgtgagccattgtgttgcaccagcttgttttaagtcccaacaatcttgttccatggtgtcttttaataatggaagagcaaagaggttaaatgactagcccaaggtctacatgaggtggaggaggagggaatcaaattaggcataaagcctattgcttggatcatgtttagtaacaaggagacggaaggtggaggatatgagaggctgatcaaggtcgcaggagcaagtgcagggcagagacagggtggcagctccctgtgccttctggaagccatcccccaagctgaaggagccacacagagccagctgtccaggcaggacctctctgcggtgacattcacatggcagagttaccaagaagaaagcttgtgtccccaagacttgtatttgaaagttaattgcttaaccttttcccaaagaatcgtcagcaaatattgcacacacccacaaaaattattttgcctttcataaagcacaagtggacatgtctttatttctctgcaaaacgagccgctgcagtgcaatcacttgaaatgtagggtctgaatgaaaattaatgctgttgatgaaaccagcagtctaaaacattacaggatattagactgaaaagacagtggtatttgcatccttttgaacattcgcctggatttgcataatggagatgtcacttatattgcaggagaaaaatcaagttacctgggctcccattaactgcctgctcgctacagttcccgtaaggggttggaacaccacctttttgaaatagaaaatgtgaaactcctacattcaccaagtgagtctttagtgaaacaggagtgaaaagaatcatgggctattgcttgctcctggcctacaagaaccaaaaaagacacatttctgctggaggcgaagaccaggaagaattcactgtctgcatatgaatgtgcgtgaacttggttgtcaggaaatgaacagtacataacccaacctgggacccttttggcctctacagcttgaaattgtaacaccagcttcactacccggttatattaatctcatgtatttttggtatctggtgacagcttctttctgaaaggcttctgtttagggcggtgtgtggtaactgtgggtgtacatcacaatcatcttggatgctttataaaaatgcagatgcccaggctccactttagtgtggaacccagatattgatattttttcagcactcttaaggtgattctaatgtgcagcctgcgttgagaagcactgctctaaaagatctctgctgcattttatccttctcttatttgaggctgttttaatggagtaaacatacaggattcagcataatataaatttaatattaataatgccagggacatctaagggcacattcaccccaacagtagaaactcagaatggggacagtctagctggaccatttatcagctgcttgggcttgggtacgtggtttagcttcttggtgtctcagttttctcactttgaaatggggataataatttcctttctgatcatatgtaaggatttatgacaatgtctatcatacagttagcctgtaaatgatacgttctattttatgtaaccattaaaacaatttctttgtgggctgtactttcatccagctggatggattttaaccaagtgatcccacctctatagccagcacccagattaagaagcagaacaagactcttcctcttatagccccttctaatcaccagcttctccccagagggaaccactcttctgacacttaactgtacagattagattggcctgtttggggactttctactgatggacccatgctgtgtatactcttttctgtcaccttctttcagtcatcatggttagtcagatgcatgttgttgttgcatatcgtttgttcattctcctccttgctgctgtgcaatataccattacgggaactaaccacattcaattctattttaattgttagtatttacaatggctccctaactgggatctcttttcaaacaattcactcttcagtccctgatatgatttggtgctgtatccccacccacatctcaccttgaattgtaataatcccctcgtgtcatgggaggcatccagtgggaggtaattgaatcacggggggcaggtttttcccatgctgttctcatggtagtgaagaagtctcacgagatctgatggttttataaggggagttcttctgcacacgccttcctgcctgtgaccatgtaagacgtgcctttgcccctcctttgccttccacggtgattgtgaggcctccccactcatgtgggactatgagttcattaaactcctttttctttataaattatgcagtctcaggtatgtctttattagcagtgtgagaacagagtaatatattccctcttatcgaatgacttctacacagtgtgaatgagatcagattcctcttcagtgcggaagaaaactagacctcttggtcctgtgttcagggcctttctcgggctccaaggccctcgttgtgactgtccactgtccatgcacgtgcactttttttctttctgaccatgcatcttcactcagggccgcctttcaccttgcttttcctgactgttctctctgcctactgcctagaatgtttttttcccatctctacgcagggaacatctatacatttctcaagatctggagttcagtttgtcacccgtgaggagcctccttccacttcgcctttgctaatccatcctgtcttttgtgcactcatgcagcatgtcacgcagacctttgttaaaggtcttatcaaatggtatttgacagtacaggtctatttctctatgagactacccgttgttcaaagcggcaagctaccaacctgatctcattcatctttgcatccttcatgctgattatagtgatcggctgttctcaattaatgaatggaagaattaatggataagtggataaatcacttaataaatcagaaatcttttagactttgctgctcttcctcgaagcataattctggttagaggtcacgtagtaaatatattcagggggttctacttcttcatcttccagggagaattgtcgcttttctcattcaacttttcagcttattgtacccccgctttgtaccccacctcactcccagcttctagatacctgaggtttggcgacccagctacgagactgtcccttccttccaccacctgatagtgcaaaattgggacaaagtcatcattaggcagcgtagttagtagcaagatattagaagtcctcagaatagcatttgcgttttcatatactactttgttaaccctatgcaaaaataatccaagatagaattttagtagatttatttccacagagaccaagatagttttcttggtggccgtcataactgtttgatgtaactaaaaataaaactagccctgactgctaataactcaaaaccggtggagattagagcaagggaaatgtggttaattcaactccagcttgctttgacctgaatttatgccaactgggacttttgcctgaattattcgggaaaatgccctgagctgccccttaattcatcttgtacgtttggtctcttacatattgaaaaagtgtgttctatgattcttttccatatagctaatgtcatcttgaccaggtcagagttcctccaagttgtttttaacatacaaatttatcacatcacgtttcatcatgcctgctcccaatggtcatgagttattgaatttgtataggagagttaatttgtaatgtccttgaggtatcatttttcactattggcctatgttggccacctttgtttacatttagttcagaaagcactaatttaagaagtgtcaggttgtaacaaaacataagatcaatgcagttagtttctgttcagactttaacaacttggtatctgtcaactgaagcatgaacatagatatgggcaaaacccaattaatacacagttgtaatcacagtgggacttagtggtactttctcctttgcacagtgggactcttagaagtggcttcattaatgttgcatttgtagtttgagttctgctcttcttctcatattgcctagttctgggcctccctgtcctctgtcctgtggccacttttccatgtggggacttttggggcctgatggctttttggtacctctgctgtcctgctagctgccaagaactctccattactccccctttgattgcttgggacacatttttaaataaagcagctttgggccacagcgacaaaaagtgtagagccatctttttgttttgcagcctctatttctgttttgaacaggtcttttcaaatcaagcggtaggagctatacctctcccagatgaggcccatcacacactctcactaagtaggcaatttctttggggtgataaaaatgattacaaatatttgaattggaatcgttgggaatctcattaaaaacaacaaccatgatcaggtgacattgtatttgtgaatatcctcagggtatgttcagaaaatcagtgttataagagcttgaacgattatattagtttagcttgatagtgctctgtttcttttctctttacacttgcatggcataatatattaataaaaattaagaaatttttagtgaaaccaatgaatttgctttcagaaaacagcattttacaatatctattgggtaattatatcaaatactcgattccatggtttctggtattggataaatgactaaatttgtaattaaacacatcttttggactaaagttactaaacagatagttgagtcaattacataacagcaatgggcattacattagattttatcacaacagtaattactgtgtgatgttagattctattttgaattgctctttctaaagatgggttatcagcaacagaatatgcattgggcttttatgagcggtctttgcactactcatatctgataagggccaaatcctatgataagaggtcagagactggtctggcagtaaagagccttcattaaattatttttaatagtaagcatttattgaagcttattacgttagaacctgaagagtcacagacatgtaaccttccccatgccttctggggtccttgctctaatttgggagatacaacacatagagaaaaaggtacatgaggcagccttgccaccggaagaaaatggcactcaaattcccagctgtcatctgggaaaggtcaattgttttctttacaaagccaccttcatagcaagactttatccatgtcagcagtctagaatgtcgtcatctttatagactcagaagcttgatttggtgtctatattcagaggttatttctatctcagggatagtattttactaatcaaatacataacagatatatacataaaccagaatgaaaacatattatagtgagaaatgtaattattgattgaactggatatttgtcttttcatgtcaacttattcattcagagcaggtgtgggaaaacaaattttagtcatgaaccgggttggaaagtattaaaaacgaggatttggtcatcttaacaaagtgtttctcagctacagtttcttcccaacagagtgggagctaacaataggaataacaatcagagccataatctctaagggcttcactgtttaccaggaattatactatgcccttagcatgtattatctcatttaactcccatgataacttttcatacaggtattattgttgcccctgtgagcaggaggagaagattgaaaaaaatcaataactaccccaagttgtgtagctaggacatagcatcaaggattccaagccaaggattatctgacttctgtttataaactatttttcttttagaattttttcctttcttttctaaaattgacataaaattgtagtttttactgtgtacgacatgatattttaaagtatctatacattgtggaatgattaaatctagctaatgaacatatgcattatgtcacagttactatttttgtgttaagaatattttacattcactcttttagcatttttaggaatacaatatattgttattcattgtagttgccatattggacaatagttctcttgagcttatttttcctatccaattgaaatgttctatcttttggccaacatctccctaacaactcccaattccctgcaaccaccccagcccctggcaaccaccattctactcactacttctgtgagctcaacattttagcattcacatgggaatgagactatgtggtatttgccttgctgtgcttgagttacttaacataatgtcctccaggttcatccatgttgtcactaatgataagatttcctgtctcatataatatatacatatatatgtgtatgtgtgtgtgtgtgtgtatatatatatgtgatattcatgtattgatggacatttaggaacaaattgaacaagggaagtgaatgatctttacactgaaaactataaaacactgataaaagaaattgaagaaaacaaaaataaatggaaagacatcccatgttcgtggattgccggaataatattgttaaaatgcccgtactacccaaaatgatccacagattcaacataatctatattaaaatatcaatgacattattcacagaactaggaaaaatcatcctaaaaatcatatgaaaccacaaaagaccatggatagccaaagtaatcttgagcaaagagaacaaagctgtaggtatcacactacctgacttcaaagtatactacaaagctgtaacaaccaaaacagcatggtactgttataacaacagacacatagaccaattgaacagaatagaaaacccagaaataaactcatgcatctatggccaactaatttccagcatagttatcaagaacacacaatgggggaaaaaaactcttcaataaatggcatttgggaaaccgcatatccatatgcagaagaatgaaattggactcctatctgacaccatatataaaaatcaactcaaaatgaaataaagatttaaatgtaagacttgaaactatgaaacaactggaagaaaacatagggaaaagttccatgacattggtctaggcaaggattttttggacataacctcaaaagcacaggcaacaaaagcaaaaataaaatgattatatcaactaaaaaacttctgcacagcaaatgaaacaacagggtaaaaagacaacctatggaattaaaagaaaatatttgcaaactgtacatctgataaaatagaaaaaacaatgaataattgaaaaatgggaaaaggaactgaatagacagttttctaaagaagacataaaaatggccagcaggcatatttttaaaatgctcaacatcactaataatagaaatgcaaattaaaaccacaatgagatatcacctcatacctgttaatatggctgttatcaaaaagataaaatataaatgttggcaaggatgtggagaaatgaggaacccttgcccactgttgatgggaatgtaagtacagctataatggaaaatagtatagagattcctcaaaaatttaaaagtagaactatcatatgattcaacaatctcactagggttatatatccaaagaaaataacatcaatatgtcaaagagacgtctgcacttctgtatgtattgcagcagtgttcacaatagccaagatatggaatcaacctaaaaattcatcagtggatcaatggatcaatggataaactatttttaattgaaagaattaaaattgtatctttatgagcctattgatgtttcagagaaataaactctggtcattgaatgaaatctctgtgttgcagaaacctctataagctcctatgtacagataatctcacagggtaaatttctctgactagctttccacattcttagcattcttttctcagagaacatgtgtatagtccttgtatagggccataattttcagatacacttttcccactcttctttgtgcttctctgtccttagttgcttttctcatttaatctttataatttccctgtgatttaaattatactttcattttacagatgagaaaattgagacacttatattcacatatcccactctaggtcagtcagtagcagagtcggatgatgcattctgttgttagtgcctggacaattaagtaccaagaaatgctattgattataggagttcatggtagggaagaataaggctgataagtaatgagtatagtttaagggcagacgtatttggaaaggggagaggcataagacaggagactaggaaatggtagacctctgtagtttattagtaatgtctgcctcggagtgacttggaggatgtggtaataaaagcatctgcatgtacccttgtggctataagtttcagttaattagtacaacacaagtacacacacacacacataagtggatctcagccatctagatgggacacagagtttttatgacaggcagggttaatgatttcataatggtgaacttttgccaatctcactactatttgaatatttcacaacttgttcaaattgttaagtacaacagcagattgcatgtacacccaataacacgggtttatgtaatgtacatgggtaaatgtacatcttccaagggagaaagggtgctctgtgtttccagcatgatggaacccagtttcatgatggattggcatattccatagatgaagaataattactggaaagaatgcagagccattggggactttctaaatagaggaatgatgagataagatatttgtttgggaaatcgctctgaagaagatggaatgaaggagagagggacttctggaaggctgtggatctattttcattttaataagcatggggggagaagggtaggagagaggatggtcaacaggtacaaagctacagtcacataggaggaataagctctggtgttctattgcataatagggtgactatagttttcattattatattgtgtatctgaaaatagctagaagggaggattttgaatgctctcaacacaaagaaatggcaagtgtttgagatgatggatatgctaattacctggatttgatcattatacaatgtatacatgtaccaaaagctcacattgtaccacataaattattaatacaataattgtacgtcaattattatgtgtcaattaaaaaaacaaaacttaaaaaatagtactaatgggaggtgaagaaggtgtgaataagggcagaaagactgagtgggacgcaagtgaatgtaacaaatgctgttctcaaatagctctaacttatctctcatgcaccagagcactcttgtttctcactgaacactttttgaatgcctctttcatgttgggcttgggcactgttctcagtggtctttgtagttagatgtttttgccaaaatgttggaaagagtccttgatatatggaaactgacaaagacataacttcaaccagtcaaggagatttcagtgtcagataaggctttgatgtgaacatgcctggcacatagatggttaatatatatcctatggatgaagaaacatacaaatgaccaaaggaatggaataggtagactaatcgaaggacattcaagatagacttctaaatgcccgaaacttttcaaagtgagatccagacctttcttgaggaatgatgtttctctactctgatctgtacagttggtgaaaataagaaagaagatggaacccagcacggcagctcacacttgtaatcacagcactttaggaggccgaggcaggaggattgcttgagcccaggagttctagaccagcctaggtaacatggcaaaaccttgtttctacaaaaaaaaaaaaaaaagaaaaagaaaaagaaaaaaagaaaaaaaaattagccaggtgcaggggtacgtgcctgtggttccagctactcaggaggctgaggcgggaggaaagcttgagcccaagaggtcgaggctgtagcgagcaatgatcgccccactgcactccaggctgggtgagagagcaaggccgtgtcaacacaagacgagacaaaatgagatgagacgagatgagaaaagaaaaagaaaagggaagaagtgagggagggaacatcagtgcaggtaaaatattatttttcttagaatgaaaccaagccagcaagaataataacttttgaaagcagtatttctccctgtgtagcccttagacaataggcatcaaaatttcttgagtgtatgtgacggattcctaggccctacctcaagcctgcaaaaataatctctcacagagagaaagggaactttaagcaagctcctcatttccttttgctgcagtaaaaatttctaagaatcagtgggttagagcttcctaagcacttaaaaactccaagaagtaaggacctgttattagaggtaacaagtataggctaatttgatttccttagaaaaccttcaaaacagcagtgtcacagaatcactcttgattaaccactggacttggaaaggcctaaggttgagaggctcagatggccccagagtaaaagccctcagtatgcctgcttcactgagcattacatgagactgttccagctctgtgatgatcaaataagaaaagcttgtgaggattttcactcttcacaatgtgatgtcttttccaataacagcattaatagagaagtgttatctttagggcatcttccttgctttatgtattttgcaataaatttatataatttttactgtttctgagtgtaaaagtaatgcatgcttgttttaaaaattataaaatactataaagcatgagtaaaaataaccaatattcctaccaccaaaagataagcaatgtcagtatatctcctttcagacatttttagtatgtacatatgcatataattttaccaaaatagaatcataccatatacactgttttgcaacctgttttatctaatctgaatggagataatatctttctgaatcatgtatattttcattttttaatggctggagaagataccacagtgtggatgtttctctttgttttattattcccttattttggatgcttgcttggattgtttatcaggccatgaaaaaaaaaaaaaaagatgaattccccagaacattataaggaaatctagggaaagacagcactaccttaccttaaactttctggctcatgtcacaaatcagtaggtttggactcctcatgcttgcagcacatacactcttgctatcctcattctctctaggaaccaccattcttcccccaagtctccatcactcatctgcttttccgtggcatgtcattcatcctcactagagatcatcttacttccctcgattattctttgttcattccacataagtgtattgagtacctcctctgtgtaggaattttaaaagaccctagctttatttagtgtttgttaaagcatctcttaacctcctctcattaaggatacagattcatgataaaaaccaaacaccttgaccaaaaggctaacttggaaaatgccagttgttattactgcaatctcaagtaatgaaaattcatggagtttatataagttattgcagcataacactttatcccaacacttagtggctgaaaacagtacataatgatgagctcacagcttagtgagatcaggcgtctcctcatggcttagctctgctggaggcctcaggctgtaatcacgatgctgaccagggctacaatcatcccaaattcagatgagggcaaggtctacctgcaagctcacttgattgttaacagaattgagttcctcataagttgtcaaatgagagcctcagtttcgtcacaggagtaatatcccatcacttttgccatattctgttcattagatgcaagtcactagttttagcccatactcaaagggaagagattacccaagagggtgagtaccaggaagctgggatcattaaagaccatctttgaagtcaaggatatgctcatagagctgatagacagtgataaaacctcagcaactgaccagaaaaggtcaacttagaaaatgagattttgtagtttaaactcctggaaattcatagatcataacatttcaacttacttttaagttgagtgacatgaagagataggtcaaaatatttacatttgctaaatgtgtacttactgttctttatatagagctttgcagcttacaacatacagttctgtgtcaatattttcatttgattttctcaaacctggaagggaggaatggaagatgttatctcaaatttaaagacaaatgaactgagacctgacaagttaccagctgagtaggttacatctttctgccagttcatgtgttggttcaacaaacgtatacaaacaaatcttatgtgcttggcaccatgccaggcagggtctggggacgcagtgttggacaacatgaatgtagttctgccctcccagaacctagtatcttgtcaagatgagacgttaatccaattaaatcttacataaaataagactgcaaactttaatattttctaatggttgaaaaggttatagatcatgatttatgcagtttatatatgcaggtttacatattttaaaattatccagctgcattcttaagatttgtacattttactgtgtatgtgatgtttttagaacatcctgggaaggaaagctacatagcgctaaggtagttcgttaaagaagacgtggctgagagccaggaaacagggatttagatttcctcttcaccaagtggcacatgtgtcctgaaaatgttaaactgtgggcatttttaatattgcacatgttgaactgatacatataactttctggggttttttttttttttttttttttttgagacagagcctcactctgtggtccagactggagtgcagtggcacgatctcagctcactgcaacctctgcctccggggttcgagccattctcctgcctcagcctcccaagtagctgggactacaggcgcccaccaccacgcccggctaattttttgtatttttagtagagatggggtttcactgtgttagccaagatggtctcgatctcctgacctcatgatccgcccgcctcagcctcccaaagtgcagggattacaggcgtgagccaccgcacctggtcagggttttatttcagaaccgtttatttccccagtacatttatccactctacctccctctctgtgattttccattttcaggctgtgccgtgctggttttacccagtaccttgtttaatgatggagctcatcatttcggagtttttctctccgtgatgctgccacatgtgtcagggctgtgtggctgttacagaggaagggtctcgtggggagggagcagtgaaactggtggagcaagcaaggtcggaccgacagactatcttctcggatgtaagagaggttgttctagggaagccgtgttcctggcgctgggaggctttacgaagagtttttgaaatctccagcttgaacgttagtgtaccttattatggctatacttggtctcaggatgccttctgccctcttattttttccttctttgatgttcaaaaatttacatcatttcctgtaatttttttttctgtaaagttttggcagacacagagtcaccactattcattttacaaaaatacatttatgcttaatttaaagaaataggcagggagaggggtgctctggttcttgttttctggcagatacttaagaaaattggaagaaatcactttgaaagatcaatgagacttcaataaagtaaatttaagaaaaaaaaaaaagagttaaggaatgaagtaaaacttgctagggttaaaatcccagctagtccattccttacctttcttacctgaaaaatgaaagtggggatcgtccttacctcatgttgttgtgagtactacgtgatgtaacacacagagaatgcttaacagagttctcagtgtagagtaagctaacaaagttgacagctgttggcctcatgacatcatagaaaatgtgcctaacctaaagtcagaatccctaattttaagccccgcttttacttcccggatattcatcctttattggttacttttaacctcctgttgcttcagttttctaaatctgtaaaagggaatgtaatactgacattatagataattccatggcaatcaaatcatggaaaatatgtagaagttcttggcacagaatagcagctctgtaaatattagtcgaatctgacttgtaacattaccaggacccaacatttatgtcaagaaggcatttttcacactgcacaaatggggctccttatattctagaaaataaatatcatgaaagtcacaacataaatgtcctctcacttcttatcccttaattcagagctattcaacaaagtcaattttgggaaaatgttgcaaacatctgatatttaccaggaattaggggagaaacagtggatactaccatggttcctgcttttaaggagctcatagtctaagagtggagtcagataagtcaacaagattacaaaataaatgccagaagaggaaaaagtgggagacgccaaggaggcaaggagggacaccaagcccagccacaataagagtgggaatgtcagagcaggtgacacagtgaggttgctttagcttcatgtgacagatatctctaactcagactgatctaaacttcagtgagaaaataaatttcatcaaactgggaggtcagaggaagggcagacttccaggtgcagtcactacagttgctcaaaaatctcatcaaggtattcggttcttttcatgtctctgatctatcatggctgctgtcatttccagtccaacagtagctctgtttcagtatcatgatggctccagcaattgcccacatgatggcatcagagagacaaggggcatctcttttatctgtcatctttgggaggagaaggaaggaaaagagaatttcctatgttcttttcagcatgggccagtgttggggccaagggaaagcttccccttcaccttccgaaggttcaccttctgccctctgaaaaagaactaatgttaggaagatgaataggagaaaaggcacacaaatttatttaatgtgtattagcctagaaaatcaaaggaggatgatcacgcaataacccagtaggtccagatgcttatacaactttcttcattggggaatgagagattgagtcaatgtgtctgtcaatttgaaggggagtaaataacttttagggggaatgaataagcccagtgctgagacaatggttagtaaataatgttctctttgggaattgaacaggattggagacaaagtttgtctgggctgtaggtgtgatgtttaatttccaggctctttgtcataataggagttttaatcttctggttaatgaagttacagggagggggttgaaggccatttgttccttttgctgggtatggtttgtaggtagataaggaaacttcaacgaacagccttatcctgtgctttgggagtgaaaggtgattgaaagatgaaggaatagggggaaggtcagagaaaccttgaggctactgcttcagtttagcatatctcaaagagccatattttggagtgttgtgttctgatccccaataccagaattaaatcatctacccacccttaaactacaccttggcaagggcacaggattctcatgacaggcttagtggggcatcttgggtgacaggtgcattgaggggttgacctccacaatgaccagggaaggttttcccaggggatctcagactttgcctatctgataggatgaattgggctttttctagtctctatgtgttagaggtagacagagaaacatcccagggtgtgcaatggtattgagcataaaatattttaattattcatggaattccaagtacttttatttgactagactatgggggtagcgcagagtccaaactagtaataggagataaggctggagaggtaggtgagggctggattatgaagactcttaccagccataagaaatgtgggttttatcccacagaaactgggaacacgctgaaatatttgaagctgagaagtacatgaaattggatgtgtcagttccatcttgaaccatccactaaatggaaaggggagtgaggcaagattggaatcttgggaaaaaagactgtgttggtaattttagaaggagtctgaatgggaccatatagctggttaagtgggtgggttggggaatgagaaggagctcaaggtgattattctgtttttttttctgggattttcaagcttccctagaagtctacataaaaatagatatgggaaaatcagaatctaagagctggctactcagatttgatgtagttaatacagaatgactatcaaataatagatatttgtcctcgatacatatgggatcttggccagctggataaataaatgagtattgttttaataaatgcccattggaacaggttctttactgaaaggaggaataatgataatattgtgttgtacgagagagtgtggatgagatatttataagcaaggcattcagcaggtgtcctgtgggttaatagtctgggagtaaattcatgttcatgtcatgtaataaccttggtgaagctgctagtaagagtgaattaggcttcagtagcaaactctctccctctctcccccacctttcctctctctgtctctctcccgtatgtgtgtgtgtagtgtgtagtttattaagtctttaagtattttattcatagcagaactttcccacttttcatattttacaaaggagcattttatttaagctccaagtatgtgtaattgcaatgagccatatacgcattccccacagaccgggaagctttgccacctaaaacagaatgctctcaatgtaagcccaggtgagagttctaaggggctgtcctggggggactctcctgctctgaagggggccatcctggtctaggggagctgtcctggtttgggagttggtggggctctccttgtctgagagctgactcatttgtaggcatcctcatttcagtgtcagaaggactgtcctgctgttgatgacttcactttacttaagcatggttcaatcagaagcaggggagtgaggaaattccttaacatatttatcaacatctgtttctaggcatccagctatgtacaggaaggaactgttgaccacagaaagcatcctgcttgggcatttctgtgcaatgtctctttgctggaaggaccatttttaatctacccgtgtagccagtatgtcctgaggtttccattctaatcccaaaatatgtatatgtcatggcacttttggagggttttgtctttctttgtacagcgttgcggtattatcataagaaaagtctagaagttgcaattatatcttccaagttggcatcccagttcttccacgtagcagctataaccttgatgcagtggaatacaggcgacatggcatgtgacttggagccagatgggagtttgtatcttagtgctgccaattaatagccatgtgatcccgggggcaaatgatgttccattttctttcatctgtacaatgggattaatactacttaccttaggatgttggtgaacagatattatactgtaaagctacctagtaggaggccaaacgcataatagatactcaataaattgtagctgtcgcaattattgacctcctggactctgtgtcctaatctacaacataggaataatgacagtgcctaacttgcaggtttggtgtgaacaatacagtgatcattctaatctagaacagggtttctcaatctcattcttggcactattttcatttgaggctgccctgtgcactacagaatattcagcagcatccctttactgcaccccctagatgggtgtagatacctgtagcattctgcagcccaggttgtaataaccaaaaatgtctcccgacattgccaaatattccctggctggggaaggtggggagctaacgttgtcactggttgagaactactgttccaacatatagaagaaagtattctataaacaagggtaggtaccgtatctgtgctatggtttggaggtggtttgttctggttcccaccaaggcttatgtagaaattggatccccagtgtgggggtgtcgggagcggggaggctagcaggaggtgtttggcttataggggcagatgtctcacaaatgctgttctggagtttgagtgagttcttgcttttgagagcccagattcattcttgtggggatggattaactcccctgaaaggaggctgttataaagcaggatgccccttgggtttcattcccttggcatgtgcccacttcccctttgactttctctaccttgttgtgacagctcaaaagtcctccctagaagtcagcgccgaatccttgaacttctcagcctgcaaacctgagctaaattataataattctgtaattattcatggaattccaagtacttttatttgactagactataggggtagcacagagtccaaactagtgataggagattaggctggaggggtaggtgagggctggattatgaggactcttgcaagccatgataagaaatgtgggttgtatcccacagaaactgggaacccaccaaaatatttgaagctgggaagcacatgaaattggaaattagactcttctttggaaattacccagtctcaggtatacttatagcaacacgaaatgggctaagacaatcagacctatccgtaaagttgtggaaagaaatgcagacaggaaaaagaaaatcatgtttgtttcctgagcctctagatagtaatgcatacatgagaatagtggaacaaattaaacctctttcggcatgaataagctcttcaaagttcagctccacatataagctacagttgggtggggctgtcaattttcaggaaaaacttgtggtaacaacacagggtttgcagtcacttctgctataagccatggtgtcctgggaatgtaagtggtaacgcctgttccctacccccgtggctgaggaacaccagccctgccctattcctctgtgggtgattgtggcgataattctagttccctggaaagcacacatctgagattcagcatgatgtatcttatccccagcacgattattttccccctcattttttcttaagcccttctcctgggaagataaaggtcaacttaaacctgagctccaggcagtgctacctcacttcctcttcactgatcaaatcttaaagcaacaggaatgttccagaattcctctaagtgaattgcacttgtctgtagttgtgtgggcagttctgaagtagctctcacctcacattttaaggcaattttactaataggagcaccaaatccttcagggccaggaaagctctatttaaccatgaatttcctcccttggggtttcgttatgtttggttacaaagtaaaataaacccacactgcttcagagtctggagaggcacaggggcatgatttagctatgttaataatagaaattgaaaagtattttaaaagataacacaccacctgtgccttcttttgattgtgagactaaatgaagaagaaattttttccccggaaatgttactgctctgaacagcattttagcactattatcccatgataacatcagagcgggggagtaattatttgccggtaatatgcgtgctgccgttagctgaatatggcagcacttccatgctgagatctatgaagtatagattatacatttccatgctcattcaaaatatgtattttttatgattgatgaggacattgcagcatgccaccttcataatttgcatttttaaatggttctgtgtgtaaatcattggcgtgtattacctcaatcagaagccaaataactaattgtaaaagctctaaaatatgcttttcttaaatatgttgtgcgggaatcagagataaatataccttaacacatttttatatttcattactattcaatatattttttttgttgttctaacaaagaaaacctccagcttttataataccattaccgtcaaattaaagactagccttcatctttccaaacatatattttgtgctttgctcaaagccaggaatgacctggctcatgaaggggttcattagcaagatgcttgaaggaaaggaaaaatttgctagttgatcgagaaaatataaatgatgaggctaaactcatatttgagatgttctagattttcctggtgagatttcaaggtccaacacaggattctaatattctcagaagatctcctacatgaattccttcaaacttgagaattacatttactctccacacaaagggagtaggaatttttcagtataaggcaaatggcaacaaaaacacactagagattacaaagccaacgtcactattatttttaaaaggctttatgaaaacattagtgctgagcctgggtgatttatggcacagatccatggaaagaacctttcctaagcccacatttcagctagggctttgcctgggagaaaaaaggaagcccttgcttctggaaggctcccctcaccgccgtctccatatgtgggaagttcagagctgaggtaaaatgaggaaggagaatcaagaccctggaaacatatgcccaagagggagcctgagaatctttgcagaagttgaagttgaaacagaagtttactaagatgctgaaacttaaagaatgaaaaccatcaactagaagagagtaggggattcgggaagcctccaaagaattcacaagaacattcagatgaagggaaagagggcaccaggtcacactgggttggttgccgagggaaatccctccccttgtgtcctaaatcattcccttgtcaccttgttatgcctcagtcctcagaaccactccttactgtggcttggtgcttgtccctccatatcgtaactctgttttatattcttttgactttcctgtttcttctgcatgtacatgagcctcattagcattgagcttgtgtctgttttgtttgcagcgttataccgagtgcttgcctaccagtgggctccaaagggatttttgcaatgactaaggtggaaattgaatttgggagtactgggatctttgggaaaagatctatatcgaagtcagatttatatggtgagagcactgtcttcagcagatgtcctttgagggtccaggtcagtctctggaggcactcccctctctcccttcttttttttttgagacagaatcttactctgtcacccaggctggagtgcagtggcatgatctcggctcactgcaaccttctgcctcccagcttccagcaattctcctgcctcagcctcctgaggaggtgggattacaggcgagtgccgccacgcccagctcatttttgtatttttagtgaagatggggtttcaccatgttggtcaggctgatctcgaactcctgacctcgtgatccacccaccttggcctccccaagtgctgggattacaggcgtgagccgccacgcccagccccctccttctgaaacttggaatgtcctgttgcaatccttagagcacctgtactcagggtatggaagcactcatgaggacatgagcctcagccttctggaaaagaggacttttcgcttgctataactcccatgggattttttttttttttaactttgtctttgtggacttcagaagtccttccagacaaatggctgctttatttgtgaggtagtgatttatatccctggcagaataatcctgggtgaaagtggctctccctcagcataaaggaatagcaaaacatttatgaaagggagacagagcttcagatgagtgggtacaaaagttccgcacaatatcaatggttgaaagaatatgcatatattaattaataattccgacatacttcttttataaggtcccttatgaaagatagactattttccacatttactgtgcattggaagtgacagatgaaattaatatgcttcataaattgccatcacagagggtcaattaacaagtgaactaaccttgtgaaagtcattttgaaagactagttatgtctgtaatattccctgtcaaattaggtaaaagtgggaaaattagatgcctgtcaaataaatagcagtctaagatacggagtaattgcatttttgataaggtaaattagtttctgtgattgttgcttgagaacagaaaatgagtagtggaaatagtaaagatctgaaaattctgtgtgtgggtacatgtgtgcacatacatacaaatatatgtaacagatgcatatttgtgtggatgtacacacatacgtacagagaggcagagaggagaacactgaagattcaaattggaagtaagacaggtccacactccttagctaaaccatcacctcctcttccaccaaggctattgccttttaggtccttcacacgtacctggccagctcccacctttctgcctttgctcacttggcttcctttttagttatgtctgcctctacttcattccatcaaaatgaaccctggtgcttgtacaatgggttggacagtgtttgggccatgcatggaccagcacaatagtgtctgctgccctagagctaaaattccctccaggagagaacaataacctaggaccctgaagctgagattcttgcaggtgacttgcttctgcctgcaaaaggactagagaaaggaaccctcctaacaaacccaactgagccagtttggaggctgaaggaattaatgtagcagtcagatcacatggctgttttcacccaatccacctgacaggaagttccagaaagaccacacaacacacacaaagtactcccacataaaggttatcctcttccaggacagatgtggtgggagcctccccacttccttcctgatgtaaaagttccatatggagttttactgctctcctgctcctctgacgtctcggttctgttcttcaaaactctgccatgtctgtgatgaaattaaatccctgactgggtctcaagttcctacttgtcatatgaatcagtagagcttaaaattcatctgaagtcttggttgtctgtccccattcctccatgacctcctttggggcttggagcaagtcaacttcttatcaggatgtgtgtcccggtgtgtgaaaggaggctgctttgcagcaaggagattgttaaaaaaaaaaaattaaaaagtaaaagtcgttatatttttgtgtataccagagcccagctacacatatgtaatgtagagaaaatactttctctccaatcctttttcttcctctgagttttctccttataccttttaattgtcagcgaattcccaaaggcatatgtactgaatctgcatgtggattttgtatatacatatatattcacaaatgcatatgctatgatttgtgattcccattttacagagtttaaaactgagtctcagtgaggggaagtaaactgcatgcagttcatgcagttactaacaacgtgccttgttgttctgtacatagcataggaggttgaacccaattagtctgactcaaggcttgtactctctatgatatccagaacgctcttttcttcaaagccaattttattccagcttggacaaattctacgcatcttcctaataaaagaagaaccttgccaggtgcagtggctcacgcctgtaatcccagcactttgggaggccaaggcgggtggatcacctgaggttaggatttcgagaccaacctgaccaaaatggagaaaccccgtctctactgaaaatacaaaattagccaggcgtggtggtgcatgcctgtaatcccagctctcgggaggctgcggcaggagaatcacttgaacccgggaggcggaagttgcagtgagctgagattgtgcattgcactccagcctgggcaataaaactccatctcaaaaaaaaaaaaaaaaaaaagaatcttgggagacagtgtgcctccacttttttgtctattggttgtattacaagttctttttcattttctgcccttgattgcacaatctccttctctccctggtctgcccagtgcagacagatacagatgagccggctcagtctgtgtccatacagatgcggaccagctcacagtactgctcttatgtgagctgctcagagttctgtgattgaaggacagggaaaaactgccaactaaagcaatagaatcattggatggacactggccatattttgcaaatctaaaagctgacagctgggtctcagaaaggacaggagcaagttcagttctggggatcccagcgagcatactgtctcttaggcagaaccaatggaataagtcctctccaaccaccttcaattcatgtgccctttgtttcttggttcctgttgccaggagagagcttctgattggcttaggttgtatcataaggccacccttcttgggcaggtttggaggaaacaacactgtgactgacacccctgccaggtctacagggaaacacagagaggtaatggccaaagataagcagaatgctgctgatgttagaagagggacaggaaagctagcaagtcacaatctataggcatctcccacaccatgtaattacataaaataaaaccacaaaagctcaatcacttgtctcttgcctccaaacctaaattgcaaatctccatgcaaaagtcagcaaaaataaaggcagcagcttgtgagtgtggggaaggccaggagaatttgacctcagaaaatctgcacttaaatcccagtcctggcaccatagctgtgttgccttggtattagatacaccattccaaagcccgctgtaaagcataagttttcccagtgcttgcagggagtcactagaaggatcacatgagatgcagcttctacaagtgcatggggaatcagcacccactcagctgaatctgctgtagaaaggattggcatcagggttgcagatagcaagtgaagctcatgcacatgctcatgagtttgcaaactgttttaaacacttgtaaaaatctctcctgagccatttatttaagtagagctgggaacattgaataaatgacagccctttcttaagggggagtctttgaattctgagtgactggcagatttcacagccattgatattttgaaaggtgcattggtgacttgaaatccttgagagcagttatctttgaaattgtggattctgcaaatgtagatattgatatccaactcaatatatgcagctttctctatataccattcagcatatgttagccatctgtcataagcatcatgcccctaaactttcagctatccagaaatctaacaactgccttttcagtaaggttactctgtgctaataattgaataaagcaatataagattcagccaaatagagtgtgtctgccatttttagaggttctcaacccaaagttgaagggccccaggccatggtagatttttaaaagaaattttgacatgggcagtgccaataaatgactctcaagaacccttaccattgtaaaaaaaaaaaaaaaaaaaaaaagggaggtccttggtattaccaatttaaaatgtgagcattctagagggacaaaacctataatgaattacaattgccttttttcccattattttagttaatgttgttaaacaatagtgtctggaattggctaaggaagaacagttacttgaaatatgtgctgttttgaataaactgatcctgtcttaatgagcttttatagggttttatgcatgacttactacccatattacattgctaaggtaacctacttaaaactgtggtgcaatatgatgtttttcagttcatttgtctgtttcattaatgatggaatgtattttccagcacacaaatcctatttatgatcaagacattgttgttctgtatatcaacttaaactcttacactgtgtaatttacctgctgtcaaatctcatttgaagagctgttgtctagcattgctctaatcaaaaatatgccccactgtaatgagctatgcatgttgtgtctagtattatttatttttaataaactttattcactcccaacacactttgggaaacggacaatctataatatcttctctcttcttcttcttttttaaccaactatctttccagctagggtgatgattcacaaaaatgtgatttttttttctttcaaatgtgtcttaatgggtaacagctgattagataaatgtacaggagaaatataaaaataatttggtatttaaaacaagactaatcattaataagacaagcagttttctaaactaaaatggctagaataatatgtgaaattagacttccaggacagagcaccctctgtgatttgaggagcccagctcattcattaaatatgatcaatatgcctcatcatggaaagactattccctgagatggcatgtcagtgtgttaaaaaaaaatacggtatttttttcatctacactctgtaaagacaagcccacaacttcatatggggctcagctgaaggtcagccatctcttccaacacaagaaaagaaaatggcggtgttggacttaatgagacatgattctgtactatacttaataggcgattttactgatttcatgggtacatcatgctgtagttttctctttacatgttgactttacattccaaattccacattaggtgcaacttcattctaagagctttgggatgcttgtatgtgaaacaggttttatgcacagctcttttccaacctattcttctttagtcagtggttcctgtgggttcttgggcctttgccttcctgtcttcagcctcttctctgagcagtgtgatatagccttgaaaagacttgggaggtgggcagaacggagtttgaatcctggctccaccctgtgtgactttggacaaggcacttatattcaactacaaaagggtcacccatgctgacgttacaaagtgatagtgaggaataacagagttacagaatgcagaagaacaaccagcacaatagtagcctgtctgtgtatgatgcttataattgtgatcatcatttatcctaagctcatatgtggaagcccacataagtatggcgtcttaccagtaaactccgctgaatccgaggaagggccttaggccttctggcaaggtaacattcagagtgctgagaatgctgctgcaagtggaatttacttatcagaaggtcagttaattccactaaactctgatgtcatatctagcttgtacaggaggcaaacaaacaaatgctaaacagtagtgcagaaccttggagttaactgtgtgcacatttaaacctcacctccaaccccactgtgtgtacagtaattatttccagtgaaatcactgctttctttccgtgaatgactaactggtgatgatattgtctggtatgatagtaactgcataagacctataggcacatagttcatcaccaatttgtgctttgtgcaatatttgcttcgggggaaaaataaaagaatcaccaaatatgttacaaactctggatttaaaaaaaaaaaacagctctaagaaaatttttaatttttttagtgtgttctcgctatcttggagttatttctagtcatcgggatcttgcatgatttaaacaaggcccttaggtgaccatcaatttatatctaaattattagtgtgcttgttatagtgggtgaatgttctttcagttcatttgctcattcaccaccaggattctacaccaggaactatgctaggttctagtgttatagggaggttaatatatgggagtatatattgaaacacattgtattagttgattttcacactgctctgagaaatatccaaataacccaaattactgggtaatttataaaggaaagaggtttaattgactcacagttctgcagggcttaggaggcctcaggaagcttacaatcatggtggaaggggaaggaaacacgtccttcacatggtggcaggagagagaagtgcagagagaaaaggggaagagcccctgataaagccatcagatctcatgagaactcactgactatcacaagaagagcatgggggaaccacccccatgatctgatcacctcccacgaggtccctccccaaacacgtggggattacaattcggatttcaattcaaggtgagatttaggtgtgtgacacagaggcagaccatatcacacatacacacacatactgaataattgctaccgtaattgatacactggcctagtggagggggaatctagtttgaactatttcatatgtgtcacgagcctggatttccagcatcataaactgggagaaacggggagcgatgcaaaagacagtcagtgctaccgctagagctggagatcagcatggtgggggatgctggctcctaaagcagaagtggggcaaatgtagggtagttggatgcagtcacagatgtgctagggaatgtggtctagggagcacagtagtgagtgctgctgagggtggtaaggggttaatgctgcaggagagaggtgagatgcgtcacaggcagctcattatctgatgcagtctatgcagagtttaatgttagaaataccagctgcgagtgcccacactctgcatggcattctgtaatgcatttgattttactcctcacagctaaggtattagttgggttacttttgctgtaaaacaaacaacttcaaaatcacactggcctaaaacaacagatatttatgcttgtcttccacatgtatgttgatcagctgagcttcatctgggctgggctgggctgggctgggctccaggctgatctgggttctggtggattccacggcttcgcctttcttcttgaacaagcggctacccatctatgagaacatagcagaggggttcctaacctgggctttgatggccccctgggattatttggcaatgtctgcagacatttctggttatcacaactcaagggaagatgttgctattggtatcccatggatgaaaatcagggttgctgtgaaacatcctacaatgcccagaaaagtcacccaccattaattatctggtcccaaatgtcagcagtgctaagactgagaaacccaaaagcccaaggcaaacttctataaacttatcactcatcctgaactcgagtctggaagcccacataaggtaggcatggcatcttaccagcaagttctgttgaaagcctttgctggtgtcacatctgcttgaatgtgatacaagcaaagactttgaatgtggaacttaccagcaagctccaaggtcaaagcctatgcttgtgttacatctgcttgaatttcatcaaccaaagcaaatcatagggccacatctaaagtctttctggttgggctttccatcctggaatccacgtttgctgggggcacttcaagctacatggcagtgagcgccagtcaagtgctgcaagtaagaatccagtactttgggaggccaaggcaggtggatcacctgaggtcaggagtttgagaccagcctgaccaacatggtgaaaccccatctctgctaaaaatacaaaattagccaagcatggtggcatgcacctgtaatcccagatacttgggaggctgaggcaggagaatcgcttgaacccgggaggcggaggttgcagtgagccaagactgcaccattgcactccagcctcagtgacaaagcgagactctgtctcaagaaaaaaaaaaaaaggaatccagtctgccacatcaatgctccccactcccaagtggggaaactgaggatcacaaatacgaagtaatctgctgaaagtcacccagcttttaagcaacagggcggggactagcacccaagttttacttcacatccttctcaggtggactgcactgcttctgcttagatttggcttgtagagtttagccaaaggaaaaaccactggaggaagctgtagtcagcctcagttttccctctgtgaagtaggggtaataatgatacctatcccatagagtaactagaaagattgaaaagatccagtatttgtaacacagtgtctaaaacatactgagcatttaataagcttaagctgctgctgcttttgccattgagaaaagacaagattatgtagggctcatttccagtaaggaaggtcttactgtgttttcctgagtgtgggttgtctagggaaattgggcccctttctcttttctttaaacttttaaatctaatcactccattttcttgtgtctttttggtgaactctagtatttggaggctttctggccttcagctattaattaaagtcatttctactgttaaaactgaattatctgtttttcttcttctaaaagcaatgaaccagggattcacacagactttaggcaatcataatcttctaaggtttgatttgaatgaaagatcccacatgaaacctgattctgtctgctacacgtaagctgttgctttcattctgttactcaaaattggcctaggacatctagaaaggaatctctgtggcacgttgatgcctacttagtggcagttcgtggctttaatgagtctgttacacagtgcaccttcctcctgtggcctacggaaatcgaaggagggatttgcttggtgggttccagtatgtatttctgagtctcagaaggtctgccaggaacaaatggcgaggcactggtattcggataaaagcagttttctctcttagtgaccagacaatggtgctgtctttcttttgaagtcactgctgggattttatgggcatagttgatcgaatcctgtgctagatgctagaaaatcagagatagggaagaccttgtccctacctctggagagctcacaggagtaaaaaacaaaaaaagcaaaaatataataataataattcaatcattattcattaagaaatctatgaaaatatatattatacaaaatatatatataacatatatatacatagacacgcagtaaaatagatgcacctgcaagtgaagcttaggcatgggttgaaggatgagtaaaagttctttgggcaaacatcttacaaagtaatattcttttcttgctgcttgttgtctcttatagaactataatttagaaagatattttgtattgtgatgctcatgtttacctactaatgtaataatttctgttgtcttttaaaaatattggcatgtttggatatcaaatatttgacctctaggattctctttggcattccttccgaaggcgtttattcctcggtgtttctctgccagcaaaggtagcattccggttttcctgtttgagatgcagacacctagatgtcatcaaagccagagacggaaagcagctgcagctatatccagtgagctggtttcttttttgccaacctaagaaggctttgttgttgttgtttctaggcatgtgaaaaacaggccgaattgaatatcggagaacagtaaatcacgactttacgatttacttcttggagagaaaaatatgaaatattgaaatcctcaatatttttcatttagaacaaggagaataagttttaaattactaaacaaaactagtgataaaggagtgtagcgagtttcataaaacatcatgtcatctatgcaaagttgtgacaggaacggagaaggaaaaaaatatgctgggtgaggaagacaggtgacaagaaaggagttgtgaatggcatgaagaatgagaacacagggaaagcttgaatgggctctaagtgaataatcaggtcatagctaaatttcaggggataagtgaacagctcactgtttcagttcttcacctgctcgttcaaaattttcaaaagcccaacgtaaatgaaatgattaatacagcccacagacagtagacgttaggcatcatggaaaaacgaggttctaagtaattctaggattattctgcagcacgtgacacaggtggtcacacctcagttagacttggactgtcttggactgcccgtttgtttatgagacagggtctcattctgtcactcaggctggagtgcagtgtcatgatcatggctcactgcagcctcgacctctcaggctcaagtgatccttgcatctcaacctcacgagtagctacgactacaggtatgccccactatgcctggataattgttccttttttttttttggtagaaacagggtctcattctgttgcccaggctagtctcaaactgctggactcaagtgatccttccaactcggcctcccaaagtgctgggattacagatgtgagtcacaatgcccagcatggattgtccttttcagacccagaccaaagaacaggacttattgtcccaagaccaatctaggaaaagtataagctgtgttgtcacccaggcattgctagaaagtggtaggctggacacaggatgaaacagttgcctgattttaaagtaagagaaatagatcaaaacaaatgacagaaatcagataatcgtctaaaaatgtttattacctatgagagtgttttcttgctcacctcaattagagcaaacaaccactatttctacaagaacagatttttcccccattaaaatattctgaagataattttgttcagatcatcagtgctgcaagtcaaaaaaggaggaaatcgggctgcttgtgaaattctcttgtcattagttccggttgcttattagagtgtgtagaccaagcgcaaggaatgagaaaaagcacacatcaccgtcagccaacaatcagccacaaagtggagcccattagatctctggcttaggctacgagagttggaagttaccgaacagattttagggatggaagaatttaggaactgctgtggaataaacctgagaagaagaaaagaatcccaagaccaaaatcttagtctgaatgtgaagtctttggaaaatgctaagtaatgacaaatatctaaaggaaactgagaccatgtgatgctaccaggtgatagtttaatgagaactgaaggttaatgaaacatttcatagagttcattgatgaagtatggaatacaaatagaaggagattgaaattaagggggccttcctgatgtctcactattttgaaaactagtttgtgctaagactgagctggcagacacagacatcaatctcttgtgaaacaattgtctattattaacgtgctaattcaggtcagatggcctggaattagtgtctcaagttgatttccttttacaccacttcctttgcagagctggacagaaagctcgtggcaatgtgtactttaatggaattaattagtatcacagcaagttgatcaacttggaggcacgtcactcacccttcattggcatcggaattatttaagttggcgcggcctctatgttaactacacagttatttttcatgcaaaatgctatggcattaaagacaacgactaggctgtcatacctcctcatttttttttctggaaaatatggaaatctggaatttttttttttttttttttttgagacggagtctcactctgtcgcctaggctggagtgcagtggcgcaatcttggctcactgccagctccacatcctgggttcacaacattctcctgcctcagcctcctgagtagctgggactacaggcgcctgccaccatgcccagctaattttttgtatttttagtagagacagggtttcatcgtgttagccaggatggtctcgatctcctgacctcgtaatctgcctgcctcagcctcccaaagtgctgggattacaggcgtgagctctgcgccgggccagaaatctggaattttgttaaacacttctgtcttaaggtgtcagcagacaagtttttaaacatgtgaggacaaattctgtgtgactatcttggggccagattcagtccatggagcactggtaggtgggagcctggttcagagccagagtgagatggtgagaaggagccacagaggtagctgtgcaaggccactggagacagcagggacttcagcagggctggctgcagactggaagtcacttaataaaaataactagcttaaggaaaacaaggggctgttactaggaagcccagagccctgggatcgttgaggggggtcaggagcacaaagaggagggaaactgaggcctccagctacagacacattatgtcgatgagattagagcctttggtgttgccggctggtgtctctctggagcagcacttgctaccctccaaggaagtggaaatgatttgcgaggcagagcgtgtgcaccctgcagtgagaccattgcttcagtggttatggagcagccagagaacataaatgaactgctagctttaggggatattactgtggtcttatttctccaaaactaaaacgaaaagttctagtgcactcactcggtgatgattcatttgttcattgattcatttctttcatttgtcattcaaccaacaaattaatgagcacctcatatacactagacactggggagacagagacaaagccatttttacacccaaataattgaggttcttatgggggggtgcagcagtatatacctgcacacagtgtcccacgggccatcatagaggtctctgcagtgagcagggggtgcccagatgaaggatgaactctgggactgtcaagaaacctggcagaaaaggcaacatctagacgttcttttactaatgtattcaggtttaaagattcatccggtctatgactctacagtcattataatgtcaggaccatctcctactttctcagtacctacaggttataattaatcattggtgttcacaacaatgattccaaggccgtcaggaactagaaccaccttctgattttttagagaaggatgacactttgttatttaattgatactgagtgtttatcgttgacttttaattctgagaaacctggcatccccatggaacatactactctgaaaagtactttcatacccatttgtttgattggccccctaccctgtagggggccacaggttactcttgctatcgtgcaaatgagcgaatggaggtggtggttagcccacggtcccagaatcaatcagctacacctgtggcagatttaggattagaatgaagacctccctacttctttctttctttctctttcttttttctttctttctttctttctttctttctttctttctttctttctttctttctttctttctttctttccttccttccttctttccatctttcttgttttctttttttcttttttttttaagagggagtttcgctttttttgcccatgctggagtatagtggcacgatcttagttcactgcaagctctgacccgcctcctgggttcaagtgattctcatgcctcagcctcctgattagctgggattacaggtgcctgccaccacatccggctaatttttgtatttttagtataaatacggtttcaccatgtttgccaggctgctctcaaacgcctgacttcaggcgatccacctgcctcagcctcccaaagtgctgggattacaggcatgagctaccgcgcctggccaaagacctctctaccttaaacctctggaaaaaaacaaaaacaaaaataaacaaaaaataaagcaaaacaaacaacaaactagaacattttattttctacctgtctgaataagcagttttcttcaccactattccatacaaaaagtgaccaccatagtacaggccatcacactctccctgcacccctctagtagattcttcactagcccatacagtttcctcttgttcctctttagtacattctttctacatgtttcagaaggatcttcgaaaattcaaatctgagatagttatttcctcaccatcctcccttacctcttgaccccttagaggttttaaacagccttattaagatataattcacacaccacacaattcacccattgaaagtgtacaattcattggtttttagtatattcccagtcatgcaaccatcatcacaggtttatttcttcttcttctttttttttttttttgaggtggagtctcactctgttacccaagccggagtgcaatggcacaatcttgggtcactgcaacctccacctcccaggttcaagtagttccttgcctcagcctcctgagtatctgcgatgacaggcacctgccaccatgcccaactaatttttgtgttttcaatagagacagggtttcaccatcatggtcaggctggtcttgaactcctgacctcgtgatgcacccgcctcggccttgcaaagtgctgggattacaggcatgagccactgctcccggcctctgcagtcagttttagaacattgtcttcacctcaaaagaaaccccatcactcttggaagtagcatccaacaccccctctttcctatctctaaacaaccaccagtctacttcttgtctctgtagatgtgtctgttctaaacttttttaatgaaaggaatcatgcaacacttgcccttccatgagtagcttcgttcacttagcaagatgttttccaggttcccccatgttgtagttgatgtcagagcttcatcccattttatagctgagtaatattccactgcgtgaatatatcacgttttgttcattcattcactgatggacagttgggttgtttctaccttttgactattatgaataatactactttaaaatgcgtaagtgttttgtgtgtggggacacatgtttttatttctcttggctatttgtctaggagtggaactgctgcatcatatcatatgctcactctaggctgaactatttgaggaactgccagactattttccagttttaatgctgttacgttgcccttaggaaagagatcaaaatgcttaacattgtttacagggacccatctgatttggccccactcacctcttcaggcccagcccatgtcacctttcccacttctgtcactctacttggtccccctggattttgtgcagtttttcaaaggtatgggcatttgctaaggctgtctccctcctcttccccatgaacttccatcagacagaccttctctgaacagccttcatccgcaatctaaatgggatctcgttattatattcttccatgtttcataagttcttaagtgattcttctttaatcccactaaatcatgactccagatgagtttaagaaatcttaagactattttttaattattacaaaccaaaagtctcacactgaacttgagctacaataggggcaccttatctatctgttgaatgaataaataacaatgagagagggggagggaggaagagaaattagtttaagaggcctcaggttgccacgttgggtttgaaatctagatgaagattgacatttcaccccaaatctttaactacttcttcctttttcactgagtaatatagcatatgggttggaaaacgttttctgtaaaaggccagataacaggtactttaggccttgcgagtcatgcagaccctttctgctgttactcagttctgcttttctagcacgagagaagccgtagacagtagatacatgaatgagcatagctttattttaatactttattcacaaaatcaagcagcagcctcgatgtggcctgttaaccataactcgacgacctctattctagagtattttgatacttgataccttcacgctctctgttttctctccccagaatcccatatttccttccacctttgttctcctagaagattcttctcagggaacaaataccttatttagaaaattttccttgacctgcaaaacagaattaaacacactctatctcatcactgaatgaggcatattcttatgttgctgcatgccttcggctgtgttaaattaattgaatatggactcacttacagaacgaagtccacaatgtcccttcttctcatccagcatcaaatatgtgatatgctcagtaaatgctaaactgaaagagaaaaaaggtgacatgaaccaaatggattatctatacaaagtacgcaggcaagcagatgatagaatcaagactttaaaatagagggaaggagaaataagtcatctgaattgatagcaataccagaacacagtattggggataagcccagtgtcagtgtgcagggtctaggtcttttattcatctttccagaacatgagatttttttcctctttttaaccagaatttttcgccggacaacaacaacaaattactttattcttcctggaaatttcttggtagcaatgcctctgccaacatgtaccatacccatacttcttctatcccatcactatcttctctcttacctggggcatattctttaaggggtagcataaatcattagtatctcaaggattggagaaacatcattgtcctaatgattcactaccatggacaccacacttggtgctttttttttttttttttaacttttgaatgagaatattcctctgaactctatgggagtacaatatttgtttatgtgtgacctacaagaatggcaggactatatagttcaaccgaacaaaattcagaagagaagggagatgactcataaattatcagtgggacttacactttgcctggtagtggcatgcttgctgtgccctttgctgcacaatctaggtggtgggtaggactatatttacactttgtctctgcatggcccgcaaacatgcagaagggatgttatgagcaaaggaacaagtcactaagacactttaattctgggctggccaggacacttaagaaagttggatgacactgtgccaggagagtctagaggtcctataacaaagccaaatgctggctggttgtcatgtgccctgtctgtactcctaagcccagaacctatgcatcagtctgcagtgggggtatctggccaaaggagagaaaatggtgcaatatgtgttaagtccagaagaaactaacagaatgcatctcatccggccacagtcatgtctggctgctgaagacctcttttgtgcacaagtgaaagaaaagatgttgagctagggttgtaagaatggcagagggatttatgtaagaaatatgagtctatttccatgacttgtgtcatttataaaggcagggacagatggaatcacttcagtgagctagaatttgtattaagttctacttgctttattttccttcatttacatatgcttattagtaatacacgtgtgagaacaaaatcatatactatcagtcactgccacacaatgaataatcccatgtaaaatatttttgcacacttttgagagtgacaataacttcactgagcttggtttcttcctttgaaacaggcagacaggcttttgctgaatctttaatgcattgtcttttggctgggttcattcaccttcagggaattctcaaaagacaagcgtcatttctttttgtctattgatctgtcctccagaaaaaagggacttctttataaactcaaagcccttagctaattcattgttcatttgttacatttattgaaaatctactgtttgaaaggcacttgttctattgtgctatggaaacaagacagacaaattcctagtcgttgagagcttaccttctagtaggcattacagaccagaaaaatggctgttcagtaggcctgtagcaataagagccgtgaaaacaaggttgggattaaggatgagtaatgagaaggagttactctttttgatcaagaagtcaaggaaggtttctgttttgaggacagacgtgaatgaaatgagggagcaagtcatgaaaactctttggaaaagaaaaaagtcttataggtgaggaaccagcaaatgcaaagaccccaaaataaaaattaacacctggtggctgggcgcagtggcttacgcctgtaatcccagcactttgggagtccgaagcgggtggatcacgaagtcaggagatcgagaccatcctggctaatacagtgaaaccccgtctctactgaaaatatgaaaaaattagcagggtgtggtggtgggtgcctgtagtcccagctactcaggaggctggggcaggagaatggcgtggacccaggaggcggagcttgcagtgagccgagatggcaccactgcactccagcccaggagacagtattgtcaaaaaaaaaaaaaaagaaaaagaaaaaaaattgagacctcttttgtgcacaagtgaaagaaaagatgttgagctagggttgtaagaatggcagagggatttatataagaaacagaagtccatgcttggaatctcagctgttttctagttctcagaatttatgagtgagattaaaagagaagcttcagagtgaaataaaaattagcttagctatcttgaagaacaccaagaaggaatatgtggctgaactagaatgattttggggagagtgaaatgatcaaagttacatccaaggttcacatcaggaccttgcaggccacagtgagaacttagaagacaattgacataggatgattggaaagcagaatactgaaaggccaatttacgtattcaaagatcgtgtggaaacctgtgtggtgaatagagtgggaggacaagagcagaaagagcaactcagaaacaatttactaagctgggtaagagatggtggcttggctgagaaggtaaccagcagatgatgagagatggtcaggttcaggttgtagtttgaagatatagctgatggaagcagctgatggagtggatgtgtataaggagcattgggcaccctgttagcaggctttaggcttctttgactcaggcattgtaccaacattcacctagtagctgatgttgattcctctctcacaaagacagtatcttagtttgaaatgcttaagaaaaaaaaatgtacctgatccaaggggaaaatggagctccacactagcagggataaaaggaaggtggttctgattatttgtgctgctcatttccatgaaggtcttgttcacagtaagcaagtttgtcaaacctatgcctaggtagtcaaatttccctaaccagggatagtctctactgggccttagcaccttccattcagtaataaaatgaggcatcttgagcttccccgaagcacaaatctctgggccactgtatcagaattatgtgggatgagttaactcacagattccggagaacctactaaatgcttgtggttgaatttcagaaatctgcattcttgcagttttcagatgaatcccatgcaaattaaagggtttcttgttttgttttgttttgtttttgagacagagtccggctctgttgcccaggctggagtgcagtggcacagtctcagctcactgcaacctctgcttgctaggttcaagtgattctcccacctcagcctcctgagtagctgtgactgtaggcacgtgccaccacacatggctaatttttgtattttttttttttttttagtagagatggggtttcgccatgttggcgaggctggtctcgaactcctgacctcaggtgatgtggccacctcgatctcccaaagtgccgggattacaggcgtcaaattaaaggtttttgattgtgatgaaaaacacacataaaatcgatcagcttcatcattttaagtgtatatttcagtagtgttaaattttttcatgctattgtgaaacacatctccggaaccttttcatcttactcatctgaaactctatagctaccctttgccccctttctgtgtccttgagagtcaccattctactttctatttctggaaatttgattactttagagagctcatataagtggaatcacacagtatttgtctttttgtgattggctttatttcagttaatataatgtcttcaaggttcacttatattgtagcatgtatccaaatttcctctgttttaaaaactgaatagtgtttgtattgaatgaatataccacattttgattatccattcatctgctaatggacatttgggttgtttctattttttaaccattgtgaatagtgctgctatggacatgagtacgcaaatatatcttttaagaccctgctttcaaatcttttggatgtatatccagaaatgggatgcaaattaaagatttaaaagcattgccttcaaatagaagagattcttgtagaaaatgaattattatgtatctggactgtggtggtggatacaagaacctgcacatgtaataaaattatgtataactaaatagacacacacatacacatgtaaacacacacacacatgcacacacacaggtgcaagtaaaactaaggaaatctggataccagaattgtataaatgccaatatcctgcttgtgatactgtcctatagttttgtaagatgtttccactggggaaactagaaaaatagcacatagtttctctctgtattatttcttacaactgcacgtgaataaaaaatgatctcaaaacagaaaggttgcccttgaggttagagtgtgccactgcaagaggagacccatctagaagggcaaagaattcttggcattgttccgaaggagaaagtggaacagggatagaggccaacccaaagtgctaagttaactctgggtcccaagggacatggcatccccaaccccagacagtaggaccaatgtagcacagatagggaaatggcagggaatgagagccagaaaaacagaggccaactcagtactgaatccccagagtgtgggcctggagctggtactgaccaccttcctcagattgcactggtcctgggaatggggtggcgtggggtccatgacctcagcccaaatcactcctcatacgaaggttggaacaggggacttggtcacatgagccctatgcttcctcttaattctgaatgagtttcagattcctgcaggcagcatcagcaacatgcaaaagacgcttcttagatgcttgagactgtaaacccttatcaggaacataatgcgatgggatgtttctctctctttaggcaaaatttaaggatactggtggataatatttacttaatgattgctatgtggcaagtgttttgctaaatgctttacaaatatttattttctgtgagatggttcctgttcttccatctcaaagatgaggaaattgagattctgagaaggtgactgagtaccttaaacaatcacacagctgataagggacggacttgggccttaaagtacagtctccctgaatctaaaacccacctttggaatctcagctgttttctagttctcagaatttatgtgtgagattaaaagtgaagcttcagagaagaagcagagagtgataacagcgatggctccaaaaataaagctgaggagaccaagttctgtcaggtgcattgagactctttttataatcccaaaactgtagaactgtaaagactagaaaagccagccacactctgtatggtactataatactgatgatgtcctatgtacttaatgtgtgtttctttctcattaatcatcaatgctgagggatgttgcatgtcttagagtttaacagccacccatagctccccatttgtaataaactctagtcagtgtgtagtcactgcctgaacaagttacaatcttaaaataaaaaccttattgatttcttttttaactttgaaattaacacatgcctagaaaaatctagaaagtatagcaaagcaaagaaaaatcactcaataaaaccactgttaatattttagcataatcttgatagtggaatgcctttattttttaaaaattgcattatgtatacactagttttagtcagaatttgtacttcttaacatgcatactataccattagtatatttttacattctctaaagtgtgtctgcaatgcagtgttgtactttctgcagataccatagtttctttcatcaatcttttataacattgtgttgattgtagttttttctatctttaagcaatattgtaatgagtatacatgttgctacacacatacacacacaaccacacacgcacatatcaggctaaatttctacaagtgaaattttcaaagcttgtgatgggtgttaacaaattgcatttcggaaagattttttcatgtaattgataatatatgagagtttatttcctcataagtctgtcaaacactatgaactttttctaattattgtaacaattttataaattgttacaatatataacatgctataaatatatgtgatgcaaatttttttacagttttctgtttattttcatataatattttagttgttgtaaaacctgcatttcagtagtttaatctgtcagtaattcacgcaataaattagagctctaatggtggcttagaagggccttctcccctgtattacttaaatattcaatgactttattcctcctaatacttaaatccatctggaattcattagactatactttaaatttgtatgtatcaaccctaatttttttaagaacatcatgtttgataaaacacattttaacacttacttaacaaaatgactttaaaactgtaaacttaaaaaaaaggtattgcatttatttctattcctctgaatttcacattaggaaaggaaaaagggcacgtaaaaatacaatccccagtaatttctctctgctggctttgttttctaaagtattatatttcccatctttgcacaaaaatccccttaacccttgtacatatccttaatagatctggcataattccatcatccaagagttatataagttctacttgaaccaattaaaatttttagcctgtgtcacctcttgaggcagaggatattcactaggactttactcaagctgcttacataaaattattttgaatatctgcatagatttcttccacataattaaagttacttcaaaagttaaatgtttaagaatgccctgaaagtctagtgtgattgtgagcgtgcatacacataagaaaaaatgttttcattatgtttgatgaaacaaaaattttaaagtaaaatttcaaattcataaaggaaatactgtacctctaagcagagcaggattttcaaagaacatttgataatagtatcaagatctttaattaataacctaacaagtaggaaacttttatcgcccctttgatcgtttttataaggagatataaacaccacatccagtctgtcaagcgggggataaatgaaggtggaggaatgttacaaagggcttaaaatgtcttttccctgggaactctctaggagttggtccgtaatgacatttaacttgaataagtgaaataaaactaagaaaaatagcttgaaatgcaagttgttggcgtcagagagaaacctggattacggtaatagaaaagcaatttcaaaggaataatggctgacaaataggaattgaatctagtatactgcatccacatttgcaggtttctacataaagatctactgggaatgactgatttccttacggagcgggggtggtcctatggggatgattggcacctctctcagattgcccagcctccccctgctcttctgggagactgtcagggtgctgctctttggactacctttgaaatcttgacctgtgacgaggctgtggctggtagtgatgttgccaggaagatggcattccaaggtcaccatactcccgctaaggtctaacaaagctttgtttagtatttctacttgctgggaatttctgtgtacacatgctcatttatctttttatttatttaacaataaaaccgagagtggtattctaaacaccatatgttgctatggtggaaactaaaacctggaaagctgaagtttcttagtaagagagcatgatcacatgacccattttgcccaggacagctttggtttgcacctgttgtttcggcttcattgttaatggtacctacttttattctaagaagattctggtttggacaataaattatgtggccactgtattaatgtcctatggctgctgtagtaaattaccacacagtgactcaaaacaacacaaatcttatcttgcagttctgtaagctgagaatccaacatgtgtcagggtaaaatcaaggtgtccgcagggctaccttcactcctggaagctcttggggaaaaacccatttccttgccttttctagcttctaaaggccacgcacattcctggcctcatggtacctttctccatcctcaaagccagcaacagctgttcatgtccttcacatatcccatcactctgaccttcgcttcttcctccctcttaacgactcatgattatattgggcctagccagatgccatataattcatgctagtctttctgtctgtctgtctctctctctgtttctctctttcttcctcctttctctctctctccctctctctcccccctctctccctatctccctctctccctttctccctctctctctctctctctctcacacacacacacacacacacacacacacacacagaatctccctctgtcacctaggctagagtgcagttgcacaatcacagctccctgcagcttcaaccttccgggctcaagtgatcctcctacctcaccctcctgagtagctgggagtacaggcatgcaccgccactcctggctagtttaaaaaaaaaaaaatacagagatggcagtctctctacattgctcaggctggtctcaaactcctgggttcaatcattcctcccgccttagccctccaaagtgctgagattacaggcatgagccaccatacctggcccaatctctgttttaaagccagctgatcagcaaccttaattccattggcaaccttaatttgggaggtggagagagtatgagaattgtagaccgaaacttcatgaaaagatttatcagtatgtctttgtttaaggcactaaattttagaaaggatatgtagatagagtactcttacccacacatcgtgatgatctaattggaccatgagtatattttcatctaaatctgcctaccaagcctgtacatatattgataatatattcatatgtaaggactcaggtgtaaaaagtaagggcaatgtaagtgtcacattaataaactgggttaggattaatgttatcatttcctgtcttatcacaacaaacattgtatccatggtggaaaatatcacttaaaaaatcttccaatcacactctaccttgcaagattatctgttataaataaacaatatagtatactgacacaaaaatctttgtgggcttatttccatggaatctctgcagaattttgttttaagctttgaacatctctgtggttcttgagacatactttcagactgccttccaggaagattgtatcaagttgagattccactacggtgatccttgtgtttgtgtcactgtacccttaacaattaccggctcttaacttttctttatctgggggcaaatgctggcatgttatttttcatgtgcatttcaaggttttgtgtgagtcaaacacacacacacacagttcctttgtctgaacttacagtcatgtttagctggagagatggcagtgttaagacttgtacatccctgcttacatgtagtgagcttctgatgatcattttatgtttcttgccctaagggaggagaccatccctcatattgtcttatgcccaatttctgcctccaaagaaggaaaaagtaaaaactaaaaggcagaaatgaaatccgcaagcagacggcccagcgccacaccctgggccttgtagttaaagattgacccctgacctaatccgttatgttatctataggttacagaaattgtatagaaaagcactgtgaaaatccctatcctgttttgttccgatctaattaccggtgcatgcagaccccagtcacgtaccccctgcttgctcaatcgatcacgaccctctcacgtgcacccccttagagttgtgagcccttaaaagggacaggaattgctcacttggggggcttggctcttgagacaggaatcttgccgatgcccccggctgaataaaccccttccttctttaactcggtgtctgaggacttttgtctgcggcttgtcctgttacagccctacagctatattctattactagatatttggggccaggcatggtagctcacacctgtaatctcagcactttgggtgcctgaggtgggtggatcacctgaggtcaggagttcgagacccgcctgaccaatatggtgaaaccccgtctctgctaaaaatacaaaaatttgccaggggtagtggtacatatctgtaatcgcagctactcaggaggctgagacaggagaatcgcttgaacctgggaggcagagattgcagtgaaccaagatcacgccactgtactccagcatgggtgacagagcaagactccatctcaaaaaaaaaaaaaaaaaagaaatttggaatgaaagcaatgagattccttcttgtttgtgacttatagacgggttccaatagaagtttctgaagaggtattccagagataacggcagtggcagcatctacgctaaaaaacattttagtgccccagagaggtaattcggagggaaaatacttattcaggtgagagatatcttatctgtctgcaaaatagaaacggagtcacattgtgttagagatgtaactactgtgtgctttgattctgtgtgatttgaaaacttacatctgaaaatcctgtgcacacacaatccattgatcgaatgttgaactatatcatctcaaaaaagctctgtgtgtgtctgtgttttgctttatttgcatattttgcccaaagaagaatcatcagagttaaagaggtcatcaaactgttttctaaatcatttctcttcggaatgactcacaagtccatggactgtgtgtcatgctttgtttctgattctgttgatctagattttgcatgtgttgcttgggtcatctcatattacaaaaaatattggcttttaagagccagcttctgcattttggccttcacccaagaaaccttgtaacacattttgtttttcatcagtacatccctttgggtaagatctcagtgtcaaattttgtcggactaaattgtgtctttcatggctgaagatgagaggatgactcaaatgaagggcaagctgttaatagttcgccatgaagctgaaggccacgcaggctttgtaatttggttcattatgttcttgcatttttaagggattcttttcaaagcattttacgtacagccaattcctattagtgtggtgaattaattggcttgaagaatcattgttttgcgtactgtgacttgatggttcacatttctactggatacctgctcacccaaccccccacagtatggaaagagagtagaggaacccaggtgctgggatgccaggaagggtggacaacagggccctaaactcaaggctgaaactgctctccaacttagcttcccttctggctcctgtggtttttctttagctccttctccatttcaggagttgagccccttttttcctcccattctcaggactcagaagatcagggctaacaacctagtgcccatctaccatgcccccttgaagtacagaaaatattcaggcggtatcttagtgtctccacctttggataaagtatttttgctttaaacaaattagaggtgatttgcatcctctgtctccctcaccatattattcactgttgtcatttgagaattaaattgacaagcgtatttttttttttttttttttttttttttttgcttttcagaaagtgtgtagtgtcatggaaggaactatgtggtagctaggctgatactataatatttcgcagcctttagtttgtggcaggatgctacataatatacagacgctcattgtgtggtttaatgtgtagcttcatgtgtattaataaaaatatataagaaactcattaagctcctcaattcatggatgattttgccacaaatgaggcaagagtaaaaagtagcaatcaatgtaaagcaaagctactaagtaaatagcttagtaaagataatgaaacaaaaaaaatgtaagggagtccatgcaaaaacattcagcaagtgtgagcacagtgaggggaatgtgagtgttacagtcggacctaagtttgagttcaggctgatgacaaatcagctttgacaccatggaccaggtccttaaatttctttgctgcgatgagtatttgttcagattgttttaagccaaatgagacagtgcaaaaaaaggccagacctgtatgggacaccaaatcaatgttagtcctcttctttttaaaaaaaaaaaaaaaaaaacaagtaatcagtttaatgtactctgatattgtttaccactgggattcttcttcatcatttaaggctacagagtccaccagcctagagtccatggagtcagaccaactgtcagctgtaatatgccggagatggagagaaaggacagatggccagagctcaggccaaaactttggattccagtctcttaaagaggcatagcctcttccaaagagggctctctgcagtcaatatcatatcagctacctgtttggcaccaggcattgggtccaggcttcaggatttgctaataaactcccgtcctcatgtggccagacagagaggtagacgtaaattgaattatcacaccaataggtaataacccatgggaagtgttacaaagcaaggaggctgacgccatgggaatgtaagccagggacaccctagctgttctggaggagtaagggaggctcttcttgatatttgggccaagatctgaaggatgaatagcggcagcaaggaagcgtaggtaggaaacccatggttggtaggagggttgtatgtaaaaatacctgcaagaaaggatgtgatgagttggaagaactgaaaaaagatgagtgtaactggataataaggaagaagagggattccttgtaacatgaaatgagtgtgaggaagtgggctgtggccagattacagaaagacttgtcaaagcaaaggtatttgctgtttttcctaagagtgatgagaaaccattgaaaggtatccaatagagggtgacataaatcaataaacattgacaaagacaccctggaagccctatagaaaacagatggtggcaggcagtcatggctgtgcaggaagacccacagggcgccttgcacagtagccctggtgagaagtgacagaagctaatctcaaggagtgttgagggggatggagagaaaaggggacattcaggaagtgaaacaatggatgtgggcaggatatgttgatagagtggctgcggatagaagagaaggtttcatttgaggaagagaatgactcatgagtttctccttccttgatccctgagagaggagccatcctctagacaatatttagagcaaaatgataaacatgcaactgtatttatcatactttctggttgctcaaaaatccttgcctccaatgatgtcaataatattttaattaagttattataaatgtaaaatagttttgccctctctaggaaaggataaagctgggcccctaaaaactggggagtaatatttgacttcagactcagtaccagctttgtatcagacactttcatgtgttattttagttaatctgcaccaagatcctgcaaagtcaccatggtgggctcttattaataacacaaaaaccaggatacggagaggtgcatgctctgctcagggcccggatctggtgtgtcagcaggattcagtatcaggtctcctgaatccaggtccagtgctctttccacagctccttaaagccctccagtcagcctttcacagatgtcccccacctccagcaattctcccctccacctctcccaccagtgcaggtggcatctggatctccctcccatgatcagccaagctttccaccgtgtgagcaggaaaccactagcactagaatctctcaaagtgctggtttaaacataaattcctaaagaatctgattttacccacttccctggatgatccataggcccactgtgataaagctgaatgagttactcctccctgggatatttcatctcaatggaggaaaataattctgttggggtccaaaaatcacaccaaggctaaggcaatacagggccccccaacactcatcaccattctctgtgacctttcccatctctgggacctctccattatactttgttttctgcaatgtttcacttttcaattaataaccaatttccttctacttttgtatttgacagcttctcaaaaagtgatcagacaaaatatgatttttaagcattcagcatgcacagttgaagattagaaggacattggaaaaaattgatgtttatgggaaatgtatgtgtatatttgtatgtgtgtgctatgtctgtggtacatgtacatatgtctgcctacatctgagtgtgtgtgtgtgtgtgtgtgtatgtgcgcatgtgcgtgctgctccagatagacctacaaacatctgtcttcctggcctgtgtacttgggagtggtgaatgagtccaacagccacacagtgaaattcctagcaggtggcaagactcagcctcctgtttggagcttattttattttcctatagctgaacctgggaatacagttcccaaattccacaagacccttggatttccatctccaacccctgtgtctcagtacaacatcactcaaacagtaatgtgcacccgaattctctagaaacaatgttaaaatgggtttcctctgtaggatctagacaggaccgaggagcctgcatttctaaccagctcctgggggatgccaatgctgctggcttggagactgacctttgaatagcaaggtactagaacacacagcacagacattggtcagatgtgtaattgctcggagttcaggctacctactatggaattagttattaaaatcctgcaacattggataactgtttctagctgtcatttgttgagtgcccctctcatctgcctccacagtggactttttttttaatatcacaccttgttattcccatgcaggtcaaccattgaatctaagaatagaaatcctcatgtctgaaggggtggtcttgaagtaggcaatgagggcctgggtggtttccatttcctttgagcaagtatttcattgccttctgccatgcctacctatttgtttttctcacagtaggtttctaccaagtggcatctcacttctaacataaagaacaagcatcagaatgcctccctttgaatgcatatgaggttgttttgtttttagaacccaaacacagccacttgaatctatcatgtaattcaaaggaaacaagcattattccagtcttttcaaactaaggttttgtgtgctttgggtatttcaattaggaagaaagaaggcaggcaagaacgttattgaacatttattctctgatactggaggatgcgctggaattcaagagcctgacttcagaaagtttggcatttgctaactgtgggtctgaccttcgtatgagaacagtgatgaaaactcacgggaatgtcagattttgttacggtatgtgattgggtggataaggctgtatttactaacaacttcctcatgcatatgcatgtgcttaattttcatccacatcattaataagatgattttaaaactggatgaacctctgcataaaacacaaacatttcctattatatattttattcagtctactatgttttcctctgtggggatcaagcatgatatacttctttctcatctctgccttcccagggactcataggaagaaaatgtcttcattcttcacttggtttagattgttctacgcaaaaactcttgtatggacataagccttaacttactccattcggagttgagcagagtcctaattctttgacttgatcttataccattccccactcctaaattagttccaattagttccaagttcatccttacctcagagtctgctattgctattcctgcggtctagaaatcattttccatgtgttttgtatggctatctctttccactttcttgtcattcaagcctcagctgaaacattccctcagcaataaggttttctccaccatttattttgaataggtgtcccctgccacacacacacacacacacacacacacacacacacacacacactttgtcaatcatactctacccagtgatggaaatgttctacatctgtgttgtctaatatggtaactactacctgcatgtggctactgagcactcaaaacgttcctagtttgactggagtactgagttttttcattttaataaatgtaaattgcaatagccatatgtggctagcagctacagtattgggtagtgaagctttcgtattcaaacctgtctcatatccttcatagccctcatctgtgactgaaattatcttgttcatatctttttctcttgtttatcacctgtctttccatgctgggttatcttttctgctaaccactggataccagggtgttcagcgtgatggctgacatgtagtgagtcctcaaataatttttattaaattaactttaagaaaatcccacttaacagcccttcactgtttttagagaccattccaaaggtcttgacttgtgttgatattattgtcctctgaaaagtctgagtcaaactctgattagttttgtaacataaaataccattggattgtctgtttgcataattggttttctgagattcagctccacattctgtattcatcctaatcaatggtgtctccttagtttctgtctttctttccattgtgttaagatggatctgttgtctgcccttcccagtttcagcatatttgaatatttggcaaatgtgaattctgattacctatcctacttgtagcttatgatactggccaagtcttatagaatgtagaatcttaggattcagatccaagatatttgttatctttaggcacagtgtttttttgtttctgttttttttttttttttttttttttggttgagttaaagtcaagtccttggctattttgggaagatgaaaaaccagacctatgttattacataaaattgcctcagagctttattttgattgatttcctttgttagcagtattctcataatagcttaaaaaaaacataaaagtataaaatttcactctctgtgagatctcctttgtgtgcagatattacgaggctctgttcacttcattttttcttattacatgcattattttatctgcaccagaaatcaagtatgtatgtctgtgtgtgaatttgctggtaaaaggatgaagtaatgttaaagaaaaaaatttaaaaattatctacccacacatacctggtttcattttgctcactgccttcaaattctatccatatttgtaggtcatgtatgatgatgctcatgttattttgtgtatttttactcaatattctaagtagatcaataaagtttaaaaattattgtattgtaatatgttgttacacaaacattccttcaactagttcccttccactggatgttcaggcagatgccagtgtaattttattttgagaaataacaatgcagtgaatagttccaaatatgtagtgcaaacttatataggatcaggagtggtataaaaacggaacaaaagtatgagtctttcgtggtttctgttgaattttgccatgcttttgaaaaggattatactggtttacaataccatcaggtggaatgtgactctactgatttataacaagaatgtttgtctttcatttttctaatttgggctcttttttgacaatagtattgataataactgtagcaacaatagcagcagttaatattcttgagacatattatatgatagaccatatttaaatgctttagaaatattgtttatagtggttaaaaaagtgagctctggaggcagacttcccaaggtcaaatctggactccaccatttatcttctctttgctttcattctctcctctgtaaaaagatccaaagggttgttatgacaatcaagtgagataatatagtatagagctaaagtaagcactggataagtgtttgttattattcctaataatgagtgtttttgttaaccccacttacagatgagaaaactgagatccagtgtcttgctcaaggtcacacagataggaaagagttgtactaggattccaaatgcagatgcccttttctgatcaaaatactcctatgcggggaccaacacttatatccaagaggaagtattactcttatcgctgagttaaatcaaggttgaattacgcacagaaaatgtgcgcataaggtccccgtgattcactggaaatgccatgacataattcttcgtttccaagacaaacaaaaaagttgtttttttatgctgccttcttcattgagatctgaaagtagttccctatggaagtgattcatggtgttgtgaaatcctccgaaattgtaaacagcctggtgggcaggaatcccgaggtctcattcaggccccctgcaaattctgagttcctagcctgaggaaagcccccaacaaatactgacctgactttctcctaaaagattgccataaacacttttggttatctcttaatgtacttggttcataactgcttagtcaattatttttattagcataacattccttttaagcataatgatattgggaaaacagaaatgatacaagcgtaatttcttggctatgactgtttatgttttgagtttttttgttttgttttaactttctttgccgatttgatgaattaattgtaaatttcccaagggggatctaaagtgaactgatctttgccttttattctggaatgttcaatttctattctagtcccagtgactatcctctgagaccaaaatttcaatattgccaagggctcataaaattgtcgatataacctactttctctagagaaccttatttgaattttcataatgaattaatatcttctttctcccccaatctctttgctcaaatagctatttgtggagaccactgatgtcaatggcaaaactctcgaggggccggtgcctctggaagtcattgtgattgatcagaatgacaaccgaccgatctttcgggaaggcccctacatcggccacgtcatggaagggtcacccacaggtatgtcacattggcttacctttagcgtaatggcttggaaagaggcacactttgatctttgtggattctagggactgtcttatggctgttccaacttgtcagctcgtatcagcgtcgacttaatacttccctgcgtagaagccaggttggaaagctaaagtgcaaagcttgaccgaggtgttgcaagctacggaaatctctttcattgtctctgaagatcatcctccaaggatgactgccatctaagtctctaaggcatggccgatgttgggcaccatgtaaatatccagcttacctttgtgaaagtccaaggctaaactttgtgctatagcagggctttgatgagaattgggtccccattacaaactcctcagttctttcttttcacagtggccttttaataagaactattttagtaaaataggtaggacttcttcccttcccttagaagatgtgcatgaagaaatcttttgtcttcagtcagaggaccaaaaggaggatgtttgatatctctctctggaaatgcgtaaatgcatgtgcctactgttatagaagtcactcaaggttactatagagctcccgctgtcttttcccatgtttaacctttctatcagggacggttttagaatttagagcttccttttttgccccaatacatacaaattaaagtatcccacagccagcagctgaagtcactcctaagtataatgcttgagaaaatgaaagaataaaacagaaaaattcctcttcggctcactttgattttcagctttaaaatacacttgagtgaaaaaaaacaccatattaagagtatcatattaagagtatcatgatactcctagattatgcccaaataggtaaaatagtgattcgtcagaccagacaggagatgagagcggcttttactatttttcccccttttctgaattgatgggatctatcagtgacatgtagatacatgaggctctggaaatgttgccatggtaaccttcccagacaaccaggtggataattgtatgcaagatgcctaaaacctcccgtcagcttcaaggagctgggtctttatgcactgcatcagatcccccaagggcaagagcgaccctcttccttcccagctttaaatgcgctccgtaaaaatgaaagcaaatgcactgcgtgtgtgctggagggtgtttaggggagtgttggaggcagatggcagaggagcaatgacaggtctggagagaaggagagagggcaggtgaagggaggtcaggtcacttcagggcagacaatccacgtggcccctctctgtgagctgcttttgatggaaagatggcttctggtgagaaacaccctagaatttcggtttgatgtttacagaaatcttcttaaacgagctgatgtgcagaacacatttggagaaccaatgaggaaagcgattaaagaggccaaagtttgagcagaacagaaaaatgattcccaattgctatctgtggtactcgggccccatgagtgagtgactagaattcagatgggctgggaaagtgttctaaatgtaaatgacagtgcttacattcgggatggctgtgagcttgcacatgtctttgtatattatgtgtgtatatgattagacggtgtccaattttcctcccactgtgcctgtccttaaagtttagaaaagaatttcagatacatgtaatattttttgatacatgtatatacatgtaatattttttgaagaaagagttctttttgcacattgaattctttatgcacatgttattttgtgtattttttatgtatgttttttgtgtattttttagatagagttctttatgcacattgaatttcttaaatcacagagttattcagttagagacagttctccagcaaaacataaaccacctcaaatatctatttatgattggtattatcctataaaaatacataaagactcaggtgtctgtatggattcattgttttctttctcagcaccctctgggttggactataaagcacgcagtgaaatagaatcagtcagatttgggatccagaatgtggaaatgttgcaaaagactttcaaacaaaaagccacttagattacttagcaccctgtaagagagttgcaggcaagatggcccccgaagcattcatgaggccagtgggaatctgatgaagaagacggtatcctctttccaacctcttcttcaacttaaatcgtttacaagtaataacaaaccctaactggctataaaaatgatcgtctcttgtatttccattatgctctgctcatctgtggctcataggatcccatgtgttgtagaaattattcgacacccactgggagtaagggtgggggtaggggtggggtttgggtgggggtaggggttggggttgggggctgactctggaaagagttccatgattttccatgctctcacaaataaaagatgggagtcagtgcataacctgccttcaaatcatatgctctttcacctgtcccgctgaattcatggtgaacacagccatcaggtatcatagcactgcgtcgagtacttactgtgtgccagcagccatatatgtacaacatcatttcatccatgatcccacttcctgccctgagaggtggctaccactatccctatcttacagatgagaaaactgaacatcaaagaggctcaggaacttgacaaagttacctggctggggaaaaggcacaatcagtgtctacgtctccagcttcaaaatttggtgaatggttgattacttagctggtaagaggctgccacatctgccttaattctctgcaaattctggccacatctgcactggcatcatgctcaaaagactagtccgggtctgtctacaatagcccgcatttcttcctgggccttgtgtgagctacaagaaacccaagaaccagctgggtggagtggctcaagcctgtaatcccagtactttgggaggctgaggtgtgtggatcttgaggtcaggagttggagaccagcctggacaatgtggtgaaaccccattgctacgaaaaaaacaaaaattagccgggtgcggtggtgggtgcctgtaatcccagctagtcgggaggctgaggcaggagaattgcttgaacccaggaggcggaagttgcagtgagccaagatcacgccactgcactccagcctgggcgacagagaaagactccatctaggaaaaaaatgaaacctaagagccacgtgacccactgggtctgctctcttgtttccatgttttacaccacagactctttgcaggcccagctgggggaagtatttgtgcagttctatcagatgaactgatttagatcctcacagaaaatgactagttcttcggatgaaatagccaggcccattgaatcacctctagggttcaacggtgttaagtgttgaggcctttgtcaccactcatgtcacttttttctgagcctacataaccaaaggcagcttcatggggcacagcctttgtggcctcacacagccaagggaacagaagggtcccatgctcagaagggcctggggcttggtttagcgttctgctgtcaccatgttgaaattcttaataattgttgaacaaggtgtctgcattttcattttacactgagcgtcacaaattatgtggctgttcctgctcacagcattgtagcctagagctgtgtttgacgctgtgctcagctatttaacacggtgtgatattgggcaagttactgaaccttctaggaccctctgcaaatggggatagaatataacagtagctaccttagagaagtatatgtgaggattcagtgagacaacatgcttcacccagtgcttagggaacagtaaatgtacaatgaatgcctttgtattgttaacagtgcaattattatttttattctggaagagtaccctttagcaaaggtaaagcaaagagacacatgagttgtgtgaagacaaattcatcttccagcaaaccacgcgtcattttcatgtccccatgtgttcgaatgccctcggcaccaatctatcacaaaggaaggtcacccatatttatctgtatgtgcagacaggagaccattccggctgctcagcactgaactccggggtattgttttggtgaatcattcctggatgaaggaagatcagcagaacataatggtctttgactttgcagatcgtgagctgttgcttttgcagagccacagacattgatttatgaggcccaagccaaggctctggctgctccttgggggcatacagatctctgtgtgagtttggtgttttctgatggccaagacatggtgttcatgagtagggggtagagggtgagaactcttgaaattcctggagggcactaattccaaggccccatcatgtcttgttggcatcaattcatgggtgttttgccctctggtggtttcctgggcacctttgagaatggctgaccatgaggaatggcatgtcaggctcccacagaagcaggccctgagatgaagattgaggcctgcctgtggtttgcttgagaggtacagggacagataccaggtaaggtgaggtacagaaaaggaagtcagacaacttgaggtgcattattattattattattattattattatcactattgagacggagttttgctcttgttgcccaggctggagtgcaatagtatgatctcagctcactgcaacctgtgcctcctgcattcaagcaattctcctgcctcagcctcccgagtagctgggattacagacacctgccaccacgcccagctaatttttgtatttttagtagagatggggtttcaccacattggccaggctggtcttgaactcctgacctcaggttatccgcccaccttggcctcccaaatgctgggattacaggtgtgagtcactgcacctggcccttgaggtgcattattaaagcagctcccagagtgggtaactgcagctttatcctttttggggagctcaaggaaatgacattaaacacatacgttagagttatctcagctaaggggcaggtagctagaatatctactcccccaagtctgataatgagacataggttcaaagctgtccccaaggatggggggctttaatttccaggcacttgccgccagctgtgcgcaagggaaacctgggatccatcagctccaatatcctgtcctcttgaggcctcggccttccaacaacatcaggagctggctgtaggttgtgttcgctctcctggcttttagccaccccaaatggcagccagggcagctgggagaatggcagccccccaccctggacgggtggggcagctttgagaaagataggtggtgagaggtcacagaaggaaagaattagctcccaaactgcatgactgacaaagatgaatgtggcatttacctaaaggtgcacgttctgtgtcctgaaagatgcacattgcttaggcatgtctgatccttcttcttgaggctgttgaagacaagcagagattagcagttacgtcctcattgtctaacttctgaaagcccagccactttccctccctctctttcctgtcttagtccctttaatttttttttccatccagtatgcttagcaagcatctactctgtgctggcgctattctaagctctgaatgtgcaacactggacctggcaggtgctgcttgttccctcctggtattcatagctgaggagggaggatagcatccaataaatcagaaagaaaattgcggcaagtgctacaacatagttgtatgggaggctcatctcgggaggggccaaacctagtcttgtagtgagataggaggccgctctgaagagatgatgtagggagtttttgtcttttatttttcctccaggatccacctgagttccttttcaagacacagttcctttaatttttaaacacatccagccattccagacataagaaaaagccagccgatcaagtcgcctttgggactaatggctatcctgagagctcagctttgcttggaagttgctattttccaaaacagcttgagctaaataaagatggctgggatagttgatagttgatatttgacacctagctcagccgatggtgttcaggttgttgctatggcctggtagtaaagtcccttttctggttactttttacttgttgcagtaactgtgatgtggcttttcaacccattgactgttaatttttttttgctgatattttcagactttcatgctgtaggttcctccattctcaactgccccaaccaatcctatgtgtttctggaatatcaggcatgtggctatttcttttttttttttttttccttaggtagatatattttttaaaaaataaataaagcaattctgttcttttcaagtgaaagaaaatgcagtcactctccagtgccaccatccagagataaccacagttgacattttagtgagtgcagttctggggttctctcctggcatctctacacagagagatgcaggtgcacagttttacagaatgggagctctatgtgcttttccgtaaatctctctcttcactcctcagggtcctatggacatttttgtaaatcaataaacatcaagcaacatcattgtttcaaacagctagagtctggatctaccatcgtctccttaaccaatttcctatcgatttaagttgttttcacttttctacacttccatcaattctgcagaagagagctcatctcttcccatgtttgtgacaatttctataggatatatttacatgagctggattaatgggatggcggatatgccctgttatgttttgatccctattcaggtgatgcttctaatcagaggattttagtctgtatcttggctaagcttgttcatgcagcaggatacaatagtctttcttttcacacacaaacatactgatggatatttttgtttgtttctccagatgacactcagtatctacaagtttttgtggtcatttcactagctgttttgtagatagtggatggccttgctatggaatccttgctggatattgtggtggaggcagaggaatgcagtggttgagactggcccctttccttaggtcatcactggaattttagtgaagaagtgctgcccagggatggcatcattaacatgctgcagagcccttgagcttggaggagacagcacttgagttatggtacaattcactgtaaatgtgttttatggtcgcctaaaatgtgtttaggtgaccataaaacacgttttatgaaagagttgcataatccaatcagagaccatttcccaaaaggaaaattcacagctaaatggaatgaaaagtattatctgaacttcactagctattgactccacctagtcgttcaagaggaaagcgaatgcttatacattgttagtggaaatgtaaacaaatacaactgtatggaaaggaggatggatagttctcaaaaaacttagaatagaactaccatttaatccagcaatcctgctactactgggcgtctacacaaaggaaaagaagccactgtatcaaaaaaacacctgcactcatggttatcactacgtatattcatcaccacaccatacatacatacacacacacaatggaatactattcagccatataaaagtataaaatcagccgggtgcggtggctcacgcctataatcccagcacttagggagggtgaggcaggtggatcacgaggtcaggagatcgagaccatcctggctaacacggtgaaaccccgtctctactaaaaatacaaaaaattagccaggtgctgtggcaggcacctgtagtcccagctactcaagatgctgaggtgggagaatggcatgaacccgggaggcggagtgtacagtgaaccgagatcgtgacactgcactccagcctgggcgatagagcgagactccgtctcaaaaaaataaataaataaataaagtataaaatcatggctttggcaacaatgtggatgccattatctttggtgaaataactcagaaagtcaaatactgcatgctctcacttataagtcagagctaaatcatgtgtacacatggacatagagtgtggaataatagactttggagactcagaagggtggaagcgtggcaagggtgtaacgtgtgagaaattgcttaatgagtacaatatatgttactcaggtgatagttacactaaaagccaagacgtcagcactctgccacatgtccgtgtaacgaaactgcacttgtactgttaaatctatacaaataaaaaagaaactgaatctttgccaagttgctcctaactatgtctgaaggtcctctggtgatatctcacaccggctcagaaccaagacagtcggctcccttgtcatagccattgggatttccctcctccatatcccaggcccccaccctgatgggcaccattgcacatgtcaggcccgccctgatgggcaccattgcacatgttaggacccttggctgctggctcatgggagctggataccaaagcatctgctgggacaggagagaatgcctgaacccctttattctggtagaagagtatctaaccaaccaacagaactgtatgtttcttctttaatgtgaataactgtgaaaacaactcttttcatttttatttatagctctctctccccctaaattcacacatgcatctctggggctggagatcagctcaagagatggacaccccattgtttcctgaaacactctcctctctaaccatgaagtcttattcctggactagcctatgtatctgcctctcctctgcccatcacccatgctcatatcattcacattagacctttgtattctgggtgaactggggagatgtggcccttgggttcactttgattacttccttgtaaaaataaacgcttaatagccctgcccactaattttttggatatgatattttaggcccaagccgggagtcatccttccatcactctatatttggaagagggaaggatttgtggcatcaaatatttaaaaataaaagtaaaaatattaaaattaattgagtaacttaattaaaataatagtttaaagtggcagcagggcaaaggagcatttgtagcttcagaaatgtagtgatcattctacagtcttttgaaaagataaacctgacaggaatttctagcgaaaatgaaaattggtgacggttgagcagctgcaaagcaaaagtgaaaaagtccttgagttgtcctagcacagaacgtgctcaccagcgccgttggatcctatccctgataccaaaggatccactgtgaatagcccagcaatttttagcactgcagctgagtaaaacagagtggcagatccaaatgtcattaaacatttataatttcggggaaacccttatttcaaatcaattcttcataaccatttcctcagtaaattcattcaacaagtatttatcgggcagtttctatgagtcagataatattataggggctggggatatagcagtgaccaagaccatttagaactctattcttaagacattgccaccttcctgggaggagaaaggtgccaacagaaatggataagccagataatttaagtttcggataaaataaaacaaggtacattgttttattgacataaggtcaagaaaagtcctctctaaagaggtgatgttgaagctgagcccagtgaaataaaggagcctaccaagtaaaggcatggagaaaggatgttccagacgcaggggccaggaagtgcagagacctgaggcaggaatgacctgagggacggtagtaccaggtgagacagggagatgggcaagggcaagggcaagatcgttctgagcatgagtcaacaaactatgggccatgggccaaatgtgtctctctgcctgttgttttttaaataaagttttattagaatacacatgtgccccttcattcatgtattgactatggctgctttcgcaccatattggtagaattgggtagcggggacacagactgtatattccacagaggcaaaagtatgtaatacctgatcctctgcaaataaaaagtttgcagacccctggcttagaactccatacattttgattacattttaaacttagtaggaagcccttgggtggttttaagcgaggaaatagatatgattttactgctgaaaaatgacttgtgctattctgtggagagagaaatagggaaacaaggcatttcaatgttctaggcatgagaaaaccatggcagctacggagatggagagaagagatcacataaaatttttacagcaagtgtgtgacaaatcggaaaattctaaatattgagtcattttatgatgccagcttattataactgatgccatctatgtggaattacaataatactgtaagccttaataggtttataaattttctgcaagtataaaccagaatctaccttcagttctctttctcagcaacacagttaagaccaggagaactgaatggttttctcttcatccttcaacttccaacatttagcagagtcccaggcacaaattatccacccaataaattccactggatgaacaaatggctccaaaggccagaaagcctgaatcccgataaactgttttttaattcaatttttaaataaatggttgtatttattgaaaatgtattcattctttcaacaaatacctttagagtacctgccgtataccaggtatgctgtttaatgaggatggggttggagggggtgaatgcatgaaacagaatggatgctgactctgtagagcttgcagacgaaagaggaagtcagtaaataaagcatcactgttacacaggggaacgtcagttttcaactgctacacaggggagcatctctctaggattaagggagggagatgatgcctgtcccagggtaacacagcagtggtaatcagctgtatatttttctagcactattatgtactggatactggtccaggttccacacctaccttttaaagcagtccttacaaacgtttgacaattgaggaaacagacactcagggaggttaggtgactccgccgtggtcacacagctggtgggtgatgaagctcagatcgaaactcagacctgtatgactctaattcttgtgctttttcatttcatccccatccacaacacccactgtcctttaactatttcacccgtgatgatgttgcaagtaattccaaagttgctaccttaaatgtaagagagcattttcttacacagatgagtgagtttatttattttcatgtgtgtgtgtgtgtgtgtgtgtgtgtgtgtgtgtgtgtgtgtgtgtgtgtgtagatgagaaagagaaagagaaaaccaccaaccttccttagtcattttatagtagcccagcttgccaggtaactccacgcagcccatccttactggtggtaacctcaaataaagccagattctccccctagcggtagtttgagagatgctcaacaactcgaagattcataaagcatgctgagccatccatcagtcaagacaggccacaaatgtcagaaaagattgataatcagcagggagcttgataaagcagcttttactgcagcacccttgctctaagactcccatcccttctgagaacgcagtctagagctgctgcttccatttatctatacaaatacctttgaatcacttcaccttaatatatatatacagtaagatttttttaaagccctgaataatttatgtatagaatcacctcccttcttaaccaaatggaagagattcagtatgctaagttcaatgggaagagggtatataaaatccctttcaagtatatgtcttataaaatataggtcatgaattgagtttttcagtatcaaagaaaaaaagtttaatagacttacagctttcttgctttaattatgggtgcattttttaaaaaccaagtatagtacccaagctattttattattcagaagactggctcttttcaaagaagtgtcaaaagtttggtttggggaattcttgtgttttctttcttgctccagttttccacttttctttagtgtgtcaccatctttatctcctatgatactagtttataaaaggcttctaacatggatgccttcctcttggaagtgggttggggttcgtgtttctatagtcaagctctgtatccttaaaaaaaggcctgcttttcagaatgatggaggacctcgctggcctgtttccctggcccatcacatccagactccagagctgctttgccatctgttcctctccttccttctcatttctgcaattttaccctctatctagctgaagaggttctatgcttgttggctcacactaaagtcataagccagggctagaggggatgacttgaatagtaacatgtgtgtacatatacgtgtgtatgtgtctgtacattcacatacacacacatgaaatcagcttcggtctgtgatgcaccattcaaaaatgtctgcgtagattttcactagctttggaaaccacgtttgatgtggtttaactggaaatattgacccacgcaactaaaactcaggtaacccaagagactactactgctggcagagtcgtgtttgctgatttcagacaccatggagcagtggtccaagtttgaatgattttgttcccaggagacactttgggttccacactggggaagaagagggtacaactggcatcgagcgggccaaggtcaaggactggtaaacatacgtcaatgcatagaacggcctccacagcaaagaatcatttgcctcaaaatgtcagtagtgccaatgtttctccctaaatggagaaaatgtggagttttagttataaagcccaaatgtaaagttggcaggagagatgctacaaattgtaggcattggttggtacctttttatagtgagccacaggaacccattcctctaagcaggatcaatggacatggagctcgttttaacagtgagcattttgcgagtgggagatgttgccaggccctctgctgagggcttcctgtgtgttatctcattgacttgccacagcaggctagaggcggatgctatgatcatctctatgtcccagtgaggaaactgaaacttcaagaagctagaaaacaaactgtccagcagagcagaagcattttcctcaaaatccattctgctgtcctttagtaacagacctcagtataccttagcagcaggtgtccgtatgaagactgtattgctcagcctccctggcagctaaatgtggtgatgtgaggaagtactgaccaacaagctagaagcaggggtctatgttagacttctaggatggattctgaaaggagccacctcacctaggaagagtaccctgtattctcctcctaccacctatttcttttgctgtctggagtagcgatatgatggctagaactcaagcagccaccttgctctgtgacacggcctcaagggtagaaaatatgtgctaggaaggcaggacaaaacacagaataagacctgattctgttgcctgcggaatgccatggcagccctggattgcttctctccagaattattttacataagagaattatgaacttctgtcttatgtaactcagtgttatgttgaattccctgtatttgtagccaaatctaataacagctgaaatatgcagcatcactcaaccagtaaaaattagagcccagactatatgacgttgagtcaagccacgctttttaaccactgtgctttgctgcttgagacataagcccacttacacctctgtatgcctttcatgcaccagttttcctatggtaatcagaaaattgagtctttattggaacaaaaatggtctttgtctcctctgttatcttagagttccttccagaaagcattctaaggcctctttgacattagacatttttattaggttaaaaaaaaccccactgccttatgatgggaactttcttagtgtagttattttgatttcctagtattactgtaatttcagatcacagtctagtactaataatctgaagagattccaataatgcacaccatgatggggctgccatttatgtcagtgtgctggcttcgtgtccacattccaggggccagagaggaaaactttaaagggctctagaaggttttcagagaatattaatttttttcttgccagtgaatcaagttgaagtgcatcatgagaaagtacctgtgagttcatcagggagatcaatgtattctgacaagggtacagcacaagggttgagatggctgattcccatctccaaaagatctggttttcagctatgtttccactgtgattatgagaccttaaacatgttatcttacctctctgggctttgagtaactcttttgatcatgaggctaataacaatgccccaaaaggatggctgtgaaggttctgtgagcaagtagatatcaggctttgagcaccatgaccaacaaaatgccacgtgggtcacaaatactggcagccagcaatggcttcttttcagtggtgctagttcaggagggtcttagtgtcgtcacccagcagcttgcaggagttggaaagactctagagacccatggagctgaattctagtcctggctccttctcttatcagctgtgttaatttgagcctctatttcctctactgaattggtgataatcttctgtggcagcactttgtacgagtttgaattgggcacattcgaaatgattcattatagaaatataaataaaattttatttgtgcacagaattagaaacagtgtgctctccaaattttaaatatttgtcacaaatttgcaatttcagagtggttgtcaggattctctctctcactctttctcagttttaatgagatatcattcatataccatacaatttaccaattcatccatacaaaatttgtcattcggtggtttttaatatattcacagaattgtgcgatcattgccacagtcagttttgaacatttctattatcccagaatggaaccctgtagccattagacgtcgttccttatagtcttaggacaccacacatatactttgtgtttctataaatttgccttgctgggcatttcatagagagagagtacatagtacgtgatcctttctgcctggtttattttacttagcgtgttgttcaggtttcatccatgttctgtgtagcaggtaacagtacctccttcagttctattgccaaagatagggcttccttttaaaataaatttgctctcgccataggaaatatcgctttagcttgtgcagatgaatatgcaccattcttcgtcaagattagtcttgagttatgcaaattctgaattatctgagatattcgacaatgtaccacgtacggaaaatacatctgtgttctgtgtaccttgcagttttgttatgagaattaaatgagataatacacgtagcagcagggctcaatatatgggagggggttcctcaagaaatagagccttctacaattttagttggtttgattgtttcatggtagatctattttttatctgctttttctataatctcaacctttttttttttggatttgggcatacacatgcaggcttattgtatggatatattgtgtgatgctgacgctttgagtatgattgaatctgtcacccaggtagcaccatagtacctaacagttaatttttcaaccctttctcaccagcaccctccgctagtccccagcgtctgttattgccatttttatgtctaagagttccttatgtttagctcccacttataagtgagaatgtgctgtttttggtcttctgttcctgcattaattcaataggataaaggcttccagctgtatccatgttgctacaaaggatatgagttcattcttttctatggctgcatagtattctgtggtgtatgtgtacattttctttatccagttcaccattcatgagtacctaggttgattccatgtctttgctatttgaatagtgctgcaacaaacatatgagtgcatgtgtctttttggtagaacaatttattttattttggatatatacccaggaatgagattgcttgttttaagtgctttgagaaattgccaaactgctttccacagtgcctgaagtaatttacattcccacgaacagtatataagctttcccttttctccacagcctcatcagcatctgttgctttttgactttttaaaatagccattccaactggtgtgacatggtgtctcattgtggtttcagtttgcgtttccctgatgattagtgatcacaatttttcatatgttttttggatacttgtttgtcttcttctgagaagtgtctgttcatgcctttgcccacattttaatagggttatttgtttttcgcttgttgaattatttaagttccttatagattccagatgctggacttccatcagatgcataatttgtgaatattttctcccattcggtttgttgtccatttactctgttgatagtttcctttgctgtgcagatctttagtttaattaaatcccacttgtcaatttttgttttccttgtgattgcttttgagaacttagccataaattatttcccaaggccaatgtccagaatggcgtttcctaggttttcttccaggattcttacagtttgaggttttaaatttgaatatttaatgcatcttgagttaatttttgtatatgatgaaatgtatgggtcatttcattcttctgaatatggctatccaggtatccagaaccatttattgaacagagagtccttttcccattgcttatttgtatcggctttgtggaagagcagatgcctataggtgtgcagctttacttctcagttctttattctgtctcattagtctatgtgtctatttatgtaccgtaccatgctgttttagttaccgtatgcttacagtagagtttaaagtcaggtaatgtgatgcctctggctttgttcattttgcttaggattgctttggctatttggggtattttttggttgtatatgaattttaatagtttttctaattctatcaaaaatgatcttggtagtttgataggaattgcattgaattcatagggagctttgggcagtatctcatctgtttttgtgtttatctcactttaaggaatctccatctatgaaaattccaactgattaaataaaaaattagtcataagtcccctctaacagacctgctcatcaagtgtctccaagatgctgtttaaaaaaatctggtttcttccaaagtgtcaggctttcaggagcccaccagtgattcaagttacataccccttcataaatttccacgcacatccacatattcatgaggcaatctgagacctttacctttgtcagcctgagtacatttctattatggcaatgtcacagccgcgtgtatgagctgtaatgaaagacagcttttgaaaactcctattctaaggtctttcctgacctatttcagcaaaatgtgtaagtgaaagacatttagacaccttttgtctttatctctttttgccctaggcaattaggtgccacaacaaatgacatttttgctccttcagcaagccatcatggctcacctcataggtgggagacaccaggatgaacactttcaaattctttatcccattccatccccccagtgagattgggtattactgtctccatgtttcatgtgaggacacagaagctcagaaaggtcaacacccataatcagagggggaaccatgtaagtctgcctttgcctgacctcaaataccatcttccttcaaggatactgcatttcctctgtctcattgtgggttaattacttcttagtatgcctgcttttcctctatgataaggcacttttatacttattcggcggtctctaacataagcattcagtcctgctccccagccaaggctgtgcatataaataggaaatgttgattttattgcttatgggagatgcaacaggcaagcatcaaaaactgtggtggggtttcagctggaagtgtgcacgttaagaagctgctctaagtcatccctgtccatggggtttttccttacagcatgagacagtccggctatgccttgtcctaattgcaactcaaaggataaggtcaaactacattttaaaaagggcaaacatcaccaggaggaaattttctagagttagaaaaactgtaaccaggaatctagagatgacatttatcttttaaagtatcaatcagagatgcattctgtttcaggcaacaaaatagcaatcagcacagcttaaacatcacaggttgattttcctcgtatttctagaagctgggagatgggtggctgcttcttgtgcttcattgacttgatagttggcatctctgtgagtctttggactttcctttgtggctccaagaaaaagaaaacatataaagcagtatttaaatatgtgtaagcacatatgtgagtatgcatgtgtgcaagtatgtgtgtatacatgcattgtgggctagggaggaaggaatttggaatggatttggggttagcctgtgagtggtcctcacactgtacccaaaagttaagagaccactaaatgaagaagaaaccagcatttcccaagcttttattatgaatttgagaattagttggtggtgagaggcatcactgaaatggtcaattggttaaataagagaaggaatcaaagtgaaactggcttctttactggcagaattttgagagacttcaagatgtgaataggcatgtcagtttccaagatgatgtcacaccagagaatctgttatgagcaggatgttccgtcagcctggcacatgggaggtggcagatcctttggaacggcagctctcagatcctgagctgctaggtatcatgggatgctgagtgggcgtgctcctcctccatagaggagttattaaagccacagagttaaagtaaaatggcccgagagcaagacaatgaatatcagagagggtcacaggacatcaagtggacttgtgaccttgggagtgtaagcacctacagtggacagaggggagtttgtgagcaattttgggataggagccatgacattaatacttcttgaatctcattccctccacactcacccctccaatttagctagctttctctgaaaagccgatactcaaagaataaaatgtttaccgaatgaattaacatgttatataaatgtcaacgcaagaattttggagggtcatttatttcactgcttctcatggggaccaagcatccatctaggttcttggtaggaaattgactatctgggatccttaagatagacataataagtccacatacaaaatggcagacagattttctgcctgtggatctacccagaactgttggtagctgtgttttgggtttccaggtagtctctccctcactttcctgttgactagtaagtgcctggctttgatgtaactgtactgtgcaagatacagagccatgattttcatacatatcacctcatttcagccttgcattatcccgagaaatagataaaggagttctcatttacagataaggacctgaacctagtacacaggaaacttacctaagtctcacaacttcccttcacatcttctctaagaccatgtgaacctgtctatataaaatagagctcaagatggaagaggtgactttaaactcataggtttttaccattggcccagaggaaaaatggagctggaactccattacttggttagtctagggaccagtgaaagtagagtgataatttgggacttttatgaatgtttcttttatagatgtttgtatcagccactgttctctagggaaacagaaacaatgggaagagagtgtgggttggaggaggcagacagaaggaagaagagagagagagattcattgtaagaaattggttcttccaaacaccacatgttctccctcataagtgggagttgaacaatgagaacacatggacacagggaggggaacatcacacactggggctttcaaggggtaggtaagcggcaaaaggagggagagaattaggacaaatacctaaggcatgcggggcttaaaacccaggtgttgggttgataggtgcagcaaaccaccatggcacaggtgtacctatgtaataaacctacacgttctgcacatgtatcccagaacttaaagtaaaatttaaaaaaggatattggttattatgattatggaggctgacatctgcagtcagtagctggagagccaggaaagctgatgtgtggctccagtctgagtctgaagtcctgagaaccagagagctgatggtatcatttccagtctaaacgccagcaggaagggccaatgtattgtttaagtccgaaggctggagtggactgatgttgtagttcaagacaggcctctgactcagctttttggttctgttcagacccgtaagtgagtagatgaggcccaccacattaggaagggtcatttccttttctcagtctaataattcaaatggtaatctcttccagacatgcccttacatccagaataagagttgcccaagtacctggttaccccatggtcagctgagttgactcataaaattaatcatccaactgttgtaggccaaatgttggccccatgatctccacctcctggcattactcctgcagttatgtggcctcacatggcaaaggagactttcttagtgtaattaaggttattaatcagctgaccttaaaacaaggaggttacccgggattatccaggtggacccaggtaatcacatgggccctttaaagcagaagaggaaggcaagagagtgaagaagagagatgcagcagcagagaagagttagagaaatgaggccaaagttagttcagagggttgccaattctgagatcctgaggattcaacctgctgctggcttgcagatggaattgggctgcatgggaagtgtgagaaataaatccattctgccagcaccccaaatgatgctggaaaaggatttttccccccagggactccaataaggaacactgccctgctgaaactgagattttggccttatgagcccctaagcaggaaacctactgtgaaccccacggaggtcatacttctcacccacagatactgttgttgttttaagccacttaatttatgataattttttacaatagcaatagaaaactaatacagaatgtggttacattatcttacataccatttaagagtaaagctgcttttcacaacaaaataacagggatttttttaaaaaagcacacacattcataaactgttgaacagctatcaaaagttcgttttcaaatgaattaccaacttacaattttcaagtattcccaataccaacatcattcttaaattaaaacagcaacggaagcaatctcagggacatgtttagcaacacttcctagtgaagctcccagaattatgaatacttttggtatgcgtgcgatgccactcattaccacgaaccgtcttttgaggaggttgcgctgactgcattaaggagctttacgtgcgagtccccagcccactcagctttcagaagtcacatcgctgcttgccacaattcacctcgctttcccagagtagacatctttcataagatgctgggatttgaagtggaaatcacactgacagaacgacatcatccctgcgattgggataagctaccatcattaaggaagtcacagttgctggtttaaggcttgtacaagcttttcgatattctccagatagtctcctgacacctacacctagaacacatgtgttggaagtaatcctttatgataggtcccttaatgtacttgttttggaatatgaccttctcctgacctgtcttcattgcagaattgctggaaagtctgaaatggggagcacagaaggtcatggtgtggtggttgacacttaggaactctcaaaaaagtgtataaattgccttgatttatcacatactgtgcgtaagttatgctgttctcattcagccaacagtatgtttaatacccaaagccctctttttttttctccttctttgtttttggcatataacagcttattgcagtataattcatagactgtatgattcacccatttaaagtatataattcaatgttttttggtctatttataaagttacacaatcatcgccacaatcaattttagaacatttaatgactcccaaaatgaaattctgggctcattaacgatcatttctcatttcctcgaaaactctttggtactagacaaccaatgatccactttctacctccatggatttgcccattctggacatttcatataaatgcagtcatgcaatatgtggccttttgtgtgtcttctttcactcagcatcatgttttcaggttttattcatgttgtaacatttatcagcacttcatttcattttattgattattaatattgtatgggattatattttattttaagtttttacgttatattttatgacatttatccatttaaaagtccatggacatcgggttgttactactttttggctactatgaataatgctgctctgaacatttttgtgtaagtttcctgtggatatatgttttcatctttttcttaagtatatatctgggaatggaattgctgagttataaagtgactctgtgttaacctttggagaaactggcagactgtgtttcaaagcagctgttccattttacatttccatcagcagtgtatgagggttctaatttctccactttttaccaacacattattattggtcttttattatagcctccttgctaggtgtaaaggagtatctcattgtggttttgatctgatttcctttttcaagattgctttgcctagtctgggttctttgtatttccatataaattttgaaatcaacgtttcaatttctgtgaaaaaagagaaaggcagctggaattttgaaaggcactgttttgaatcaatctgtagatcaactggaagagtattgtcagcttaacaatattgagtcttcccatccatgaatatagaatgcctttccatttatttttgttaatttccttcaacaatgttttatagttttcaatagacaagtcttgcatttattctgttaaatttattcctaagtatatttgatgatattgtaaattgaattattttcttaatttcttatgtggattattcattgttattatatttaatcaattgattcttgtatactgatcttgtgtcctttaaacttgctgggagctctcttttaacatagacattattatgcttattttatgtcttcatttatttgctcaaatctcgtagtagagctactggagcccaacattcatattctgtttgttatacactcataattatacaagtacatgtgcacaagtcaaatattaaacagatacatactgaggtagcattgttccaaatcctcatctatttgagcttacctttctaacgtgtgaactaattatggaaagaatttggttgcttgctgtagctcatgacttaggacgcattttcccctcttcaactgtcttttatttgagccatgattgaattattcaccatgcctagttgttttccttttcctaaacatttaaaaattaactcattttcttttttttctttttttatttcaataggttttttgggaacaggtggtgtttggttacatgagtaagttctttagccgtgatttctgagattttggtgtacccatcacccgagcagtgtccactgtacccaatgtgtagtctcgtatccgttgccatgcccaaccctttccccaagtccccacagtccaatacattattcttatgcctttgcatccttatagcttagctcctacaggtgagtgagaatatatgacattcgattttccattcctgagttacttcacttagaataacagtctgcaattccatccaagtttctgtgaataccattatttcattcttttttatggctgagtagtagtattccatgttatatatatatatatatatatatatatatatatatatatatatatatatatatactaggtttttttaatctgttcattgattgatgggcacttggcctggttccatgttcttgcaattgcaaattgtgctgctataaacatgcatgtgcaagtatctttttcgtataatgacttcttttcctcttagtagatacctagtagcaggattgctggatcaaacagtaggtctacttttagttctttaaggaatctccacactgtttttcacagtggttgtacttgtttacattcccaccaagaatggtcatgatcaaaaaatgaaaaaataatagatgcggggaaaagggaacactttttacactgttggtgggaaaattagctcattttctagtagcagtatatctctccaacaaacaagtcacctgtttttttttcctgaacacaccatctctcatcattcttgatgctaaaatataagcatgtaggtccaaacctgtctctcctcctttcagagtgaccagagagacccttctagtgttttgttttgtttttttgagctggggtctcctgtgttgccagtctagagtacagtagtgcagtcatggctcactgcagcatctagctccaaggctcgggtcatcctcccacctcagcctccccagcagctaggactacaggtgtgcaccaccaggccctgccaatttttttaaatttatttttcgtacagatggaatctcactgtgttgccgaggttggtctcacatccctggcctcaagtgatcctaccacctcagcctcacatagtgttgggattacaggcatgagccaccatgactgtcttcttctagtcttgatgcctctcctctccatctgtagaccccactcctcctaggtcacttcctgtgaccccacaccaacatcctttctctagaaacggccattcccaaactgtgagcctcgtgtttgtattcatgacacatatgtagcatccactgtgaagtcaaaattaaggtgaatggtaaactcaaccacctggcttcatgttgaccttgtccctagactcccattccctgcagctggtcttgctctctactttgaaaacacagttgatgccatctgaaacgatctcctccacttggatctctctgcccgtatttacctgtatctccaatatctcctgctactcaagtatcttctttttattaaaactttcatatcgttggctaggcgcggtggctcacgcctgtaatcccagcactttggaagtctgaggcggacggatcgtgaagtcaggagattgagaccatcctggctaacatggtgaaaccccatctctactaaaaaatagaaaaaattagccgggtgcggtggcgggcggctatagtcgcagctactcgggaggctgaggcaggagaatggtgtgaacccgggaggtggagcttgcagtgagccaaggctgcgccactgcactccagcctgggtaacacagcgagactccatttcaaaaaaaaaaaaaaaaacttccatattttcagttctatcttctttttattcttcctttacctgtacctttattgatttattttaacttttgttttaggttcaggggtacatgtgcaggtttgttatacagggaaattgtgtgtcacaggggtttggtgtacagattatttcatcacccaggtaataagcatggtaccctataggtagtttttttgttctcaccctcttcccaccctccacccttaagtaggtaggccctggtgactgttgatcccttcttcgtgttcttgtgtactcagtgtttagctcccacttataaatgagaacatgtggcaattggttttccatttctttgttactttgcttaggataatggtctccatttccatccatgtcactgcaaaggacatgatcttgttcttttgtatagctgtgtagtattccacattatatatgtaccatatttctttaatccagtctactgttgatgggcatttaggttgaatccctgtctttactactgtgaatagtgctgcagtgaaaaaatgctcaacatcactaatcattagagaaatgcaaataaaatccacaataagataccatctcacaccagtcagaatggctattactaaaaagtcaaaacgaaacaggtgctggcaaggttgcagaaaaaaagggaacatttttacactgctagtgggaatgtaagttagttcagacgctgtggaaagcagtttggtgatttctcagtgaacttaaaactaccattcaacctagcagtctcattgttagatatatacccaaataaatataaatcattctgccataaagatgcctgtacttttaattctattttctgttgactgccccatggcctttctttttaaatcattaccctctccttcctgcatcttcagtcacattctccatcatttcttttgcattagtggagaaacatatccaggtctcccaatcctaatatgagagaatccactatacccctgcctttttgttcttgcttactgcccattataagcccttttcctctttcttggcatacttatactttctgaaaatgcaatgtttattatgtcagccatgtatacatctgctgttgtgaaagataattttaggtggcatagaggtgatcttttataattttaatagctatttattttgatgtacaactaagcaatacctggtacgtttccataatttaaatcatatcattgcttagaagtaagttaaatttcaaaaatcaatttaaagtatattgaaagtagattaatagtggtactgtcaatacttacatatgaatcactgaaatactggaaggctttgcatgtaagaaaagcagaactttaaagacaaacggaactcagagtggatagtacccctgaatggacagtgcttcacgagtcttttctggatgaccctaagaaagttagttgtctacattgcagaaaggctatgaagattagagcaatgtatttaaaggaacaagaacattgtccagaaaaaaaataggtgtttaataaatggtaactaatcatcccccggaccgtatatacagatatatagggatacctttggggaaagtagaatggcccaatatgtaggttattcagttccacgtaagtgggtgttcacgagatgcttcctgatttgaaacatcaccatcatcaacaataacagcattgatgagaggtcatcatgggccaccactgtactacgcctttcagatgtacacctcactcattcccagtttgcaacagctttgtatgggaggttctgtaacatccccactttataggtgagaacactgagtctcagggaggtgaaatattttacacaagattgctcaactagtgacaggtgaagcagagattcaaattccagaagtctgatttcaaagttgtctctcttaaccactgtgttgtatctcaaatcatgacagttctaacttcatgtgtcatggtacttggcataaggacgtttttctccccattcttccccaaattcagtgcaaaaaatatatatgctgagtttttcatgggccaggtctactctattcttagagaaagggtcgggtgcggtggctcatgcctgttatcctagcactttgggaagctgaggcaggtggaccacgaggtcaagagattgagaccatcctggccaacatggtgaaaccccatctctactaaaaatataaaaatttactgggtgtggtggcatgcaactgtagtcccagctactcgggaggctgaagcaggagaatggcttgaatccgggaggcagaggttgcagtgagccgaggtggtgccactgcactccagcctggtgacagagcgagactcggtctaaaaaaaaaaaaaaaaaaaaaaaagacaatgacagagagcgacaactcatctctgcatctctgctttctgtggggaaacttgcaagtaaaggagactgacaagtgatggcgttaaactgtgctaagttgacaaaacacagaatcctcactgcctatgaatatggatctagggaagccagcaatggacctttggcagagtcaagtgaaatctttataggagatgaactgaaatagtttagaaagaatgcattaagatagttttacctaaatagtttatcgtcatatcaataaaattgatcatctctatcaccagttttaaagttggctttgacaacttttccaaagccagagtttgggcatatttgggtatttccataatattgagcaaatgtttaaactatattgaaaacgtttgccgtgcataacagcatcccaataggaagcagacggcatgctcaaactaggacagttgtaggaggacctatttttaaaagggcctagttacaaaggggaattgcaaaggataggagcataaccttgggcagtaagaactgagtaggaacagtgctccacagagagtgcaaagtaagctgatgggttgaagctaaggagcagggaaaagatctagaaggctcccaggcagaaagtgattggtaagctgagtcttgaaggaatcccttctggatagcatgagaagcttgttccggaagaaggaacctatgtacgaagacctgaaagagtaaggcatgatctgagaatacaggtagagggggtgtgacttgggcataggctatggggatggcagggagtagaaagggctggaaaggccaccatgatacaggtgttggagagaggcaggcatcatgcaaagtgtatgtgttaagactattaggaacaaaatatttgtggattaaagatataacacagtggttaagagaggcagctttgaaaccagacttcttggatttgaatctccgctttacctttcactagttgagggatcttcgataaaatacttcacctccttgagactcagtgttctaacctatccctagacctgaggaatgaaggaagagtcactgatctggaaggcgtgagtcccatagagagcctcgtgggaggaacagagaccaccagcatgggatacatccaaccgcaggcaacccgaaagggaaggatccaggggaatgagcatgctgaccttactcaaccaccaccttctgatctccaaacgcaacaggaagtcgaaggtctttctctattcaggccagcctctaaggacagaggggaggcagtggagggtactaaggcgtgctaaagggtcacactaatgatgctccgcaaagagtgcaaactttcttatatgttcttgctgctgttccataaagcaaagactggatccacataacctgatggagcaaagtcttagtccaaccccttagcctgcaaactctggaattttagaaaagtcaatagtgtgccccagacatatttcaatatacctccattttactccaggtaaaaggtttcttgcatccatttaactattgtaaatgaataaccatgtgaccctcaagaagattccaagccaaattccattggtttctaaggtcttaggtttgcttgcttttggcaaagagtgtacttatcttttcatgcatgcctttaaagagaccatattttttctctgataaagtcaattatcagtgtatgtgctgctctgttcacagttttgactaaatagtgcaacatctacgtagaaaacataccccaaacttgagttttcctgggttgtgcattgtacattgtcaaagcgtaaagaacatctgagttggaactcgtacccacttcaggatatgagaagatgcaggtcagtgatttgtttcgaggcggaagaagcttaaagaaagtaccttgcgctgtgtgttcctccattagcatttgttattatgaaagcattagactatctctggatgttttccacacacctgagagtgtgaaagaatgacaggtacctcattaaagatgcataatatctagtctcctgttctcacacagactccaaccactggtatgaatatactgcttccatatgagcctgctgcaagccagccagatcctattcagaatatctcctttctaccacatccaaatgtgggcagcctatatatacagatttgaagtgcaaagggtttgagtcaactttttgataaccgtggggattttccatctcaagaaattccgaaaatgatgtaatgatataatgtagcagaattttaatttagtaggtaggattaagagctgacaaatttcctctctttaagtttctttaattctgtctgtgcaagtcagagcattcggtatattcccaccctcccagctgatatgctaaaattggtttcactgtactactctcaggcatgcaatgagctaggcaaagctgtttagttacttgcgatctgtttacattacatagaaggttggttaattagaaataatcatgtttcttaattaaggaacaaattgatttttaaagaagtgctgaggcccccttgggccacagcagataagggactgagctcatggtttgtggttgtctgtgtgattctctttaaggagggtctgaagtgtacagtgacacagctatcagtggctatggaatcaaatatttgtagattaaaaattgtactcattctgctgacatcttatgagtatctgttgtgtgcagagaaatatgttggaggactctgggaacttgaagataagtaagacaaaatcagatctttaatggagctgagggtggcatggtaaaaacaggcttgtatgttgtatatttagcaaactgtgttaagtcctagaagagagatgggtaaatatcccaggaaaacactgagagcaaagtaagctgatggggtgaggctagggagaaggcaaaagatctagaaggctcccaggcagaaagtgattggtaatctgagtcttgagggaaccccttctggatagcatgagaagcttgttgcaggaagaatgaacctgtatacaaagacctgaaagagtaaggcttgatctgggaatacaggtagaggagatgtgacttgagggtaggctatggggatggcagggagtagaaagggctggaaaggccatgatacaggtgttggagagaggcagacgtcatgcagagtgtatgcattaggactattagggtgagtttaagcagggaaaaaaaattgcatcagctcatttatttaaaggaccaagaggagctttagggatagcagtatctaggtgttccaactgtattgtgaagaatctttcttacttattccttggctctgcttttctctgggatagctttccccaggtgatagcaaacaaaaatggccacctggcattttccctactattttagcaaatgaagctgcccctcgcccttcataaaagtattgttcccatgtaactccctttaaagttttaggtatgcctctgttggcccagtttaagtcatgtgcccatccctgaattagtctctgtatgcacagatgtggaagactcaaaggggcttgtgcctacacctagagccaggtatgggggaaaggtgataccagcccttcctcaacttcaaggactaagagtgaaagaatggtggtcgcttaagggaaaaggagaatgctgatatcaagagcaaggagaacagacgcaggacagaaataaatagatagctagtatgcaaagatgtcaaagtgacagctcttgatgagttttgagtaaaaacgacatggacacattttcattagaaaaaaattattctggctttggagaatgggtaggagagaggaacatctaactcggtgagatgctagcatgatgacaagggcttggtctcaggtggttgtggtagagatggtgagcatgagacatgcatactctagagagagttaggaggtacaaaagatggacttgggggtttctgatacattacaaagggccagaaatctttgagcatcttgtcccctccccttgattctaggtgaggaggggacattgatttgaccaatacaatatgtagaagtgacactctgccacttctttgatccaggccttaagaaatgggttgatttaatttactgtctcttgcaacgttcactctgatagaagccagcaccacataagaagtttggctacctggagactgccctgtgtggagatgctcaagctatatgaaagggccttgaaggatgacatactgtatgaacagagaggtcaaggaggagtgaagcactattcatgggaataaaggagctatatcagaattagactctccaaccctggctgacctcatgagaatctgagatgtaccacccagctgagtccttcctgaatccctaacccacaaaatcataaacacgataaaagtgacaaaatgtttagatgttttcattctacagcactaaataaccagaataagaactgaattaaacataaaaaggagggaggggtttatgttatcagccaatggcaagcaccactgaagtttttaacaaatataagacaaaaggttaaaccacacatctggcccacacccagcccccagttcctaaaaagcctggtccatctcttcctcttcttgccacatctcaaaggctatctctctatgtggatataaattatagatttaggttatagtttcccttcctcctggggtttcctctttgatgggactgtcaaactcttgggtgagctttattgtcagtcacagggtctgtcagttttcccatagtagtattatttcactcatcctttaatgtgcccattggtggtgacaaattttctaacatgcaaccacaggccataaatgtaaaaataaagcaaaagtcattgaattgaaaagcaggagacactttgcaaggctccaaccagtgagcttccatttcttctgcctgataatgactcccacacttatgccatttcttgagaactgtaaccagaaacccatgttttgggagtcaatagaatagatcagagcaaagacaaaggcaagagaagtgagattggtctttgttctggtgttatctggtagaaagaccataacacacagctaaccaataaggtactttgcaaaaattagaaaaaggtgtccccttcaagcagataagttctgagaaagtacccctctggaaagaagcagaccattgaggtcttggcttaatgagtagaagatgaatttgcatgtaaaacaaatatatcccttcttccagagagctgagcaagaggagggcaggctgctctcagtaccctttggacccgctaccatgcatggtggctttgaaaaagccaggcatttgcttcctaagagcacaccttgcagaagcagcatcaccatcatcactacgatttatccagcctttgctctatggtagatgctgtgcaagtgctttcggtctcatcctgaaacaactattgatatagatgccacatagatgacaaaacaacaactgagaatcttgatgccttgccctgaaacacacagactaggagtgggagagctgtaacttacacctgacctttctagctcacatgtggcctcctgttcagcggagagggacttcttggagaggtgccctgagaaaaacacatcccttgaccatgagtttttaacagtatcagctctcatcgggacattattatgttctagttgtctgcaacgataatatatgtgactgttattttgtctcatatctccaataaaggggtccccttcagttggattggccataccttcaggtgggatgcaactgtgagtctgtgtacatggcccagaagcaaatgcagcacagtggagtgattaagactctgatatgatccagttattgctggactggatctctgtttcttattatcatatttgcatgaccttaggcaagatacttgactgctctgagccttagtttcttcctctttaaattgggatgactgtagtttgttataaaaatgctgtagataattcccagacttgtaggtaacacatattattaaacagtagaactgtcgtgaccattaccagaaagattttacaaacaccctaaaatcatcataggattcagctagtgttcttagccttctaagctcacaccattgtctcatgctaaacttgtggtccaccagaaacttaagtgcatatttcttataattatttccaagataggtttctccagtttagaaattgtatatacacatgcatctatatatatatatatacacacacacacacacacacgtgtgtgtataacatatgcttatccttgatgtcatatttacccatgatttttattttaattagctttaccccatgggaagaatacaatgtcttttgtcttcaacctggtttgttggcaattattcttagcctttttaaaatattcaaaatctcataagcatgcattctgcatcttcaccaaagtaataacaactgtatatggtttagaagggcactgactacctctccctcaagtgtcaactaaaaaatattagatacgaagcttgagtcaagaactgtcctgggtgctgttgactcttctacgtccggtgtcttccatggcctatggtacaaagtcactccagaacattggatggatggatgggtggagagacggatgagtggatggatggatggtaaggttattgaatagaatagaattatatatttatgtttacctttgcctaaaaggcaaccatacagtgttttggtgaggttgatcaaccagttatatatttacctaagagtttgatcactcagcccacgttttcccatggtatgcacaacttgatcatgagaaggttttcacaggccttcctgaaatcatgatactatatatttgccaggctcctggtttatcagttacacaacaacagacttgaagaagaaaaccagctcacatctgtgcacaaggagacacacagttgttcattactgcattgtttgaaaaccactacgttgtaaattgcataaatgtgtatcaatgggtgaatggctaataaaaactttaaaaataaatataaaactgccattcaaaggaatgaacgaaatattatataaatatataacccaataatttctataaagattatatgtgtgtgtatatagatatatgtattatatatgtgtgtgtgtatatatatatatatatatagagagagagagagagagagagagagagactgtcccagaacaaggaagccaattttagggcatattccatataatacaatttttaaacaattaataaacatatacataaaatataccatattattctcagaaacaaatatatgcctaagatgattcaaaatggacattggtattcttgcgtgaggatgagagtggttgtcattggtaaaaaggttgaaagtcatagaacaggatatgacggatcaaagatcttaagctttatctgtaatattttatttcttttaataaaataaagacaaagcaaatgtgacaaagtgttaccagttggcaattccagatggtgggtgtgctgattttcatactattgttctttgtgcttttctgtgttttcttaaaattcccaaaatatgaaactgaagaaggaaggtaaccatcattggttgctgactgtcagcccattcattctatttttgctcccagctattttttatttgaagataaaagacgtgacagatacacgtgaaacctttctatctacctacctaatttaggattagacttagctgcatgtaaaagaaaaaaaaatctcaagagtgagacatttctttttatcacataaaagacattcagaggtctgtatagggcagtctggagacgtcatttgggacaaaattctaccattctcagcacgtagattctgccctccaggccacttcatggctcaaggtggctgattggagctccagccttcacctccatattctagaccaacagtaccctcccttcccaaaattacctctgcttacagctcatgggccagaattcatcacatggccatgtaactgcaagggggatagagaatatcatgtttcattagggcacattacccaaggtttttttttttttttcctttaattaaggaaaaagagaagagtgtatattaggaagtaactagcagccctgccacaaaaatgccctcatcctcactgccctccctcccttctcagaggaaggcactctcttagagttagtatataaccttcttgtctatgtttctataattaaataactatgttcctatccatttaaaatacatggttttattgatcttaaagttttaataaattctgcaattattgctttcttgttccaggaaacatgctaagtacttcatgcttattatttcattgtgtcctcaatagatggtaacaactacctatttaatagttgcttgcttttttcacattttagcaaatgtacctttttctaatttctaaagttgatgttccctccttgccatctggagtgagcacatctctttagcctccaccagttcctaactgcctgaaattttcccagaaatcgtggactccccctttccctgccccttcatgtcttcctggatttctgacatctggcttctcctgcctgtgcattaagagttccaaacctctctgacttaagccaacagtgactttcagtgttgtgcgttccctatccatgttcatgattttttagcaccgagatcgcatcagcaagaaccctcaaagccctgggatgcagttcttctggatctcaagtcttgaacacattaaatgataagctctttacagactttctcttcccaattattaagcagcaattacccttcacatcaccttctcccatatcacctctataattccaaccactctcacctaaaaaagctcacctaaacccaccacttgtctatctgagtcaaatcattccaaaccaaagctgcacatgcctgaaattagggattaaaaaaaaaaaagtaccaagaggataaacaccttccttcctttactagatccagggtatttttcaactgaatgcagccattgccaccctatatttggcttttagagacagactgaagtctaacaagttgctccttatacttgaattcacaagtataaaatcatatggatgacttgtgcaccttgctgtcattctgtgcagagctctgcctgtgcactccttccctcacttaccgagggcctagttcatcctccacctctgtggacacaggaacgacgaaaaagtctcccttatgacctaacggcttagagcatgggtcccataatccaatgtgaatgggcttccaccccaactctaccagctacttattgtgtggttgtgagtaagtcacctaccttctcagaacttctgtttcttcatctatagtagaaggatactaattcctccaccatagggatgatttgaggacagcactgactaatagccataaagtacttagcttgctgcctggcacataatgaagacaaaaatgaacattgaccaatactagcatcatctgcatctccaccatttccaccatcatccttaattggttgtgcaaataaatccacaagtacaatttaatcaggtaaattaatggaaatattttattctggggttattttaaatgtacagaaaagttgcacgaacagaacaaagaacttccataccccctcatgctgatccccagctattcacatttcactgcgtacactctatctccctatgtatgtatctatgtgatgtcccttcaaccctcagtgctccatcatatctgcctccccaagtacaccctcctgcataaccaccatgcaaacccacaagtcaagaaatgagcactgaaacaaaacccagtgcatcaatacattgatgcaatgtccaatctccacaccccgttcagggtttttctagccctcctacctttcccttcttaaaaataccttctgcaacagtgagaaatcttcattaacctcagatctgtccagctgtcctagtgatgtctctttttcatatctggcccaggattccatccagttacaccaatggttctcatctggagctgactttgcactcccctctgaccccacccatggtacatttggtaatgtctggagacatttgatcacacaagtgggaattggtattgacatctagggcttagacaccagagatgatgccagacaccgtgcagtgtgcaagacagaccccaagaattatccagtcaaaaatcttgaaagagctaaagtgcagaaaccccgagttacacattgcatttaattgtcacatctttgcagtctgccccagtttggagcatttcctcagtctttccctgactttcatcgtcccaacagtttggaagaatgcagccctacattctgcagtgtgatgctcaacgtggtccatctgatgtttcctcgggaccagtttcaggtcatacgttctggggagaaaaaccacagaaatgatgccatgttatcagtgttccacctgctggggcacacacaaccaaccctgcccaaggctcaggaatgttagcctctttcacctggtcatgtcaacatcctcaggtttccccccaaaaaagtcaccattttcccctttataatcaaatttgcagcaagatattccagatcatcgatcttgtgatatgctgctctcatgagacctcaactcacaagccttgactcacctgccagttcttagctgagcatctgccctgatggtgtggagtgatttcctttttccatggctccttgtacatttatggttggcattctactgcaaggaagactgtttcctcttctcccattagtatattcattcatttattttttatatcagaatggactcatgtggttttaattctttgggttgttttctgttgctgtctttcttttttaatgctgtgcttaaattgtgtcatatttggccagggggagcctggggcttttgataattcctcatttatttttactgcttactttcttatacaatgagatattctgaactcatgttgtaccttcctgcccaaccctggattgagtgacttcctcaaggaaccttggtttcttttcatggagggtggtctttagaaatcagtgtctgggtatttggtgaggttgtggctgctggagtgtcactgctgctaggtcctttcagcagacagagcaatgatacagacacacacatatacatacacatatacatccacacaaatatacgtacatatatatgggtgtacacatatatacacatgggtacatctatatgtactcatttatacatgcttgcacatatgtctacaactactgtatctctctgcattgttcatacattaaatttaaaacacaagttcaaactgatatctccaattccaatctaatatctaagggtttttctagccctcctacctttcgtgtttatcaataccttctgcaacagtgagaaacctattattattctcaatatatctactaattgatttgatgaaatcacatgatgtaaccagcctctcaaccatgccagccatctctgctgactgccacctctgcctgacttcccagagccccatatcccaggctaccagcaggcactggtccttcctttcttccctccaagtcccccaggccagtgaaagaaggaaatagactaccgaggcgaatttatggacagaacaatagggtcaagggttaagccaagaggcttattacaagaggtaatgcaaagaggctttctgcaggaatcaacaccttgagctgccccaagggcatagaagcatcagcaaggttaacaccctgtgggaacacgagcagaaggaatggttctgccaaaggcatggaggaagagagcctggtcactctggcacttgcatgtgggtcagcagcatgggatccgagggtatggagaggggagagtggtgaagaggaggctagacaggtgtgcagggccacatggcaaaaggcctcatgtggatcaatgtggactaatgatgaatctttcctgtctcactcttcaggcatgcgcttggcttttggattctttaagtactctcagataaatccacctgtcctttccaaagtcatttccatctattatatacaagtctcatgagttgtcgtgtgtaacatggtatgtccaacttctaggaaagtattttgtacatagtatatgctcagtaagtattttaaggcaccaatgtatatttttatctcaaataagctctcctggccctctttcaaacaaagatggttggcaaacagcagccagctcccagcacaggtggcccctactgtctctacatttgtatggaaaatgtaatgggtcatgaaattgcatgcattagcatgcggatgcttagacatatatattttttgcaaacatttcatcctataaaagtaagggaccaaagtataaaattctttagaggcatcagctggaggtagtagtcaatgagagagaatcattgtttccattaaatagtaccagtttttgtaaggcaagtaagatcttcatgttaattctaagaaactgtatgcctcattaggcagctaaggcatattatgatttggatgcagaataaccccagtgataaatgaatctcccagcagagtagcttccagattataatttctttctttgcaagattgctataggcaaggtggcctgatcacttttcagaggcccatcttaatagtcagagtaagctcagctatgctgtagtaacaagaaaatcccataatctcagtgtcttaataaattaaaataacttatttataacaaaatgtctaatgcaaatagggctccttcatcttgtagttactctagaacatggggtctctatggtcacctatggcatgggaaaagggattgaggtgacattcagctctttgctcagcccaagaatgaaactcatcacatctgttttcagtccagtgaccaatactagtcatgtggccccagcataactacaggagaggctggagaatatatgggaacctcctcacattcaccaaatggaatctttggtgaattctaaagattcccggcatgtcccactatctccttttggggctgagaaaatgaaagaaaaaactgacaggccaatgtactgactgctctctcacctgggtctgatcccatctgaagctactttgggtggttatcacaatgtagtttatcatagtgctgtggaatatgaactatgaccatagccagccctatattctagaaccagcatctccatttgtagctatgggtgcttggacaaacacttcaatgttctccatctcagtttcctcatctgaaaatagagtaaacaacagtaccaacctcatagggttgtgtggattaagtagttagaaacatgtcgctgttgaggaaacatgagctgctgttgtatttgaaatggtgctgaattcagaatcccatggaaatcttcactatgacaagaattaaccagcccagagccacatggagaaaagatgtgtggccacgatctcttgaccgaatccagcatcagaatccaccagacaaaaccagcatcaggacattggccacaaagggataggcgtcccaggatgctggaatgttgggggcagcgctattattagagacacctggtcactgacccagctttcttcccatggctcaagctgagacttgatagtaaaaactgccttaaatggaagcaactatatttttgatgtatgctcttctaggatgatactaaaagccatatataaaagaggtgttggttcaaaataagtgggatttttcagttccacctatacccggatagtattacccaccctacttgaggactctaggaggcaggtaagctacagtgaaatgtgctacccttgctagttgtggtcacttcatttaaggtaagaggttgtatcttcatttaacttgatgaggaattttccatcatacaattagttttgactgcaagtataagaaaatctaaccatggtggcttaaacagtttgggggatgtttgttggctgctggtattgattcaacatcatgatgatgtcaggggtgtccccactgtgattctcttagccttttctgcaagacagctgcctctgctctagtcatcacttctgtatttaaggaagagataaggggaagaagtaaggtccaccccaccttttccattgcatctagaaagccaaagtttccctgaaacatcatctttagctccctgctgcaagagactttcgcctacattttcttagccagaattgtgttatatgcccatccttagtgacaagggaagtttggaaaattaaatacttgtgttcatagactctattatagaggcaggggaggaaaacaggggccagaaatgagtgttaggtcaaccaagttacaatgtctgccccaggaacttatccaagaatagtatatgtgagaaggaggaggaggaggcaaggtacccattcttatgctcacttgagatgccatatttgatcctccctagcattcctcaacttaagggctgttctttcttctgcaggaagaaggcttaagatgtgaactggaaagttcttattctccactgagaactaattgcctgcagcaggtttcggctcacttctagttgtttactattttccaagtcactgtgattccagaaggtattgggcctcagtggagctcaaaatggatattagctcttgggtgtgtttcatcgatttgggcacaggagggaaattatacacagaggattgtcatcctggacagttaaaaatttaaagtaaatgaactgaacaaacctcctcccttaaatagtgctcagaaatcaaagagctgaaaaaatgtaaatgggattcattaagagctacaaaattatcttcttgtgttgctttgataagtttttcttgcaaatctctagaagtttagctcagggcaagtcttggacatggttgagaatgtctgccttatgaatggcgaagtggacaatggggaccagtgagaagaggctcttaatatgtgaccatcttaggatgccactggctcctacagcagtccccctggcactttccccttgctgtctctttctttgccttggtttgcagtgtttacacagcatgtccaagtgctagtttgagttaattttcattatgctcattttaacacaaaggacttgagtattcaagaatttctgtagtgctgggtttttactttctctgttggcaagaattacctttggttaacctttgtcttatagactcattgggtttcagttatcaggactggggtaaaagacctcctagacatgacacctactctgacagagaccaagaatccggcattgacaccctgaggctgtacttggctggcaggttttttattgttgtttggactgtgcagtgttttataatatttaagaatcacatttctgggctaggcatggtggcttatggctgtgatctcagcactttgggaggcaaaagcaggcttaagtccaggagttggagaccagcctgggcaacatggaataaccctctctctggaaaaaaaaaaaaaaaaaaatgttagccaggcatggtggtaatgcctgtagtcccaactacttgggaggctgaggtgggaggatcgcttgggcccagaaagtcgaggctactttgagtcgtgattgtaccactgcactccagcttggccaacagtaagatcctgtctcaaaaaaatcacatttctggctttttttgatcaacgagatttgatgatattggacaagtgtttggaggtggcaccatgggcaggagctgaggagcagctgcctgtttggatcatggcagctacagtcctcaccacaccctattgccttgcactcttcccatgatgctgatttaccaatctctgcatggccactttaggccctgcgttggtgtaccccatccagattgtctccattgtaaagccatatatttccaagggcacagcaggtgtgtgtggtatgctgagagtccccttctatctctccaccaccctctccatacttgctccccaggatggccatggatacagctacattagcctcacctgggtgcttcttagaaattcagaatctaaagctcagcccagacctactgaatcagaatctgccgtttaataagatccacaggtgatctgtgtgctcataaggtgggagaagcgttggtctaaagcacaattttcaaacttggctgatgataggaatgaccagggcgcttgtgaaaaacccattcccaggcaccaccctaaaaccagtcagagccgacagggaagggctctgagaatccacaggcttaacatgtgccccagtgattctaagacaatggtcaattaaaaagacttggcttgaagacttagttctcaaacgggtatgcatcagaatcactcagattgcttttcattttttaattaaagaaacataatttacaaaaatcacattattgtaagaattttaaaaagtcagatatgcaaaatataaaactataaaattgccatagttgttattttagcgtatcttaacgttttagtgtataagcatttttttaggtgtttgtgtgtgtatattttttaccaaaatgagatcgtaccataacgttattttcaaatctgattttctcagttaacaatctctatctttctataagaataattttcccatttgaccccgaattccaatttacagtgaattgttctgtctaaactaggagccaatccagatggatctggttattccatcctttatgttttttataaacaagcacattcttctcctcctcaatccctttattttattctccacataatgctgccttattgatggactggaccatttattctgcagatagtcccaccttttagacttatctggtcacttccttatggtgtcacatagcttgttgctctgtcctggggtgcctttgtttattctctttaatgcattttccaagactcccctcaaactccaatgaattaaagttttcagagtttggggcctgggaatctgaagtggttccactttgccaggtgagtctgagtttgagaggaaaggtgtcctagatcattcagcagcagcagaagagttggcccttaaatctacgaagaacattgccctgtgcatctgcatgcagacagggtctgataacatcaaagctgggagtctctccaacgctttaactaatgggatctgagctcggctgtttatttatagtcattcagtgataagaaagtcaacttggttggaaggagcttctgtcctaggcttgcagctggggccttagctacccttgtaattttcccagaaaaaaaaatgcacatctctttgagtcctgggccatgtgtaaatcagtggtaatacaagaaacatggagcaccccagaaaatcttcagaccctgagtttggagctgaggaactcagaaacactcaatttcatcgaagccccttcatacagctttgaatgcatacattatggggtctgtggctcagaggtaccagtgctcagagcagtatctgctttcctagtatggcctgtgggcagtggtctcagcatgcagcatcactgaacagaaccctgcatatgccataatttacgtagatactatggaggtggaaccatgtatggttaagtcccggggccctggagcagtagatcttaaccttattggacacagtatcccatttctatttacaaatacttttttttttttccatgagaacaaccacagggacttttaacttgcctaaagataatgtgtgattttgagatgtgattagggattatcattcccacagtgatcctactatcaacaggaactgctgtttctattatcaacaagaatatgcctccaagccaggagtcctgctgatcccactgtctccccaccccaacagccatggcccgagatcagattgtctccatggattctagtgctcagggaagttaagaaaactcaattcacggtgctcagttcaaccttagacatgcatcagaatcactcacattgctgtttaattttttaattaaataaaaatatttattcagccgaggtagctgaagcaggagaaggaagagcctcaactcaggggaagatttgctgtcaccccctgacactgagcagaggccagtcaaatccactggagctgacctctttgatgtcaggctcagcagaggcctggctcttagcaggccagcttcctgtgcttgggattgcttgtcttagctttcagaggatttaattgctgattcaaaccatacaaagtacaacgaacagtatctactggtgggttgaacaaatgggttccaatgactcaggcccgagtgacctctgctgcctctaacctccttcaccatctgctgcccagggggtcctgagaggccaataagtatctgccaagatgctctttagtatccttctgtgacattcataagatgttaacctgcctacacacttttttttttttttgagacagcgtcttacccgtcgcccaggatggactgcaataacatgatcttggcttactgcaacctctgcctcccgggttcaaatgattctcctgcctcagcctcccgagtagctgggattacaggtgcctaccaccacacccagctaatttttgtatttttcgtagagacggggtttcaccatgttggcccggctggtctcgaactcccgacctcgtgatccgcccgcctcagcctcccaaagtgctgggattacaggcatgagccaccgtgccagccacacatttaaaataatgataatagtaagccccaattatactataaaggaacaactaatttagaataggaggtctaggtaaatatgcaaatgcaaatactctggcgcaacccccctggaaaacataatgaagtggtcccgccagagtatcctcacacagggtcaccaccaacacattgcatcagctgccatgcagacgaacacaggtctgttttgcattgtcacccaagtgacattcagtattgccattggttaggcaattttccagaattggtgagattctgaaccaaacaaaaaacaagatcacctcttttgacacagggtctgcattgtggtgatgtgtggaatatgttcatctgtacgaaaatatttggggtttgagtgtaaaatcgagttgggttctagactcagataaacaagattttttttctcccccacccaaagactgtttatcagggtcattcgaaatgtatgtggggcaactctatgtagtcaggagctccatgcatcgcggggtgtctaacacctaattgtcacctcccactaaatgccagtaacacccccgattattgtgacactcaaaaatcgccccctcgcacttcgaaagcacacccctatacacactgatcttctgttaaccctgccttgaatgacttcggtagcctgaattcccatcctggccccactgcctcatagcttcgtggccctgggcaagcccacaacccccaaacctcagtttcctcatctgtgatatgggtgcatggaggaggttaaataacagctccaatcttaaagcctccttagcgccgtgcctcacgagctgtaagtactaaatgaatgctggctattatatataacttatattgtatattatttatgattgttcctaaaattatcactaataagtgcttcacagcaatgagctaagattctgagtgctatttcatggattttagagaaataattagattctagaacctcaattatcatcgtaatgactcccctgatagagttccaaaactgtttctttgtgaccactcacagtaagaacatcacacgaatgaatattccacctgtcttaggtgtgcacacagaaggtactgacggttctctctgagcagttccaagccctcatctgggaccacgtcttcccaagaccaagccctaagtcgtgatataaaacaagaaaagacgctgggagtacagtcagcttcaaagacagaaccagcgcacgaggcagaatcacagtgtcagagcttctgtaattacacgctaaattatgcggtgccatctttaaattatgtaggaaatagaaaaaggaaaatctcggtggaggatggaggtagcttctagaaggaggtgggcctgagccgcccctgaagaatgttgggaatctgggtcaggcaagaggctggaggagagaggtgaagagctggaaggaagttgggaggggagaggcccaggggagggcatagatggagggtgatggggtgtgggtgcccaggcctgggaattcagacctgccaatagccctttcaagggccagagacagttccctgccagaataaatacatagataaatactatttaaagcaaaaacaaagtgtcaccaatatctagataaagtgtccccaaggatacatctggtgctattccgtgagaccatgtcacccagagctggtgctaaactgatgccaaggggtgcccatggaaatgccacctttgggtgggcagaggcatttggctctgcactggtttttatggtgtgggaaaggaagcattctcgtgggaatattgttcttgcctccaggaagggctgtgggaacgtgcagttactgcagagggacatttctgagcatacatgcttgtttatgatgatggatgactggctcaggagagagctaaaatgatcctttccctagagatgtgaggagaagccagcccagaatttctgtcacaatctgctgcccgagtccagtgactcagaaacaaagttcatctttactgacgtgccatggctgccaggaaccagggcagctgctaagccaccaatccccagcccacagttttgtgcggaggagacatagacatatatgttattgcaattatggctctactgaaagaatgaatgaatttaatcgaatcaatcattcattcaattcagttgaatcattcattcattgaattgaatcattcattcaatgaatgaatcccctggtcaaggaaccaggctcagcccacaatgtatgcatttattcattcattcatttaacaagcaatgccaggcttctggcctcagggagtacatgttcaccccctagtggagggagacacacagtaaacatagaatacattaggcaatgagaactgtagagagaagcaagcatgaagaggaacatagaatactatgcagccataaaaaagaacaagatcatgtcctgtgcaggaacatggatggacctggaggtcattatccttagcaaactaaggcaggaacagaaatccaaataccgcctgttctcgtaagtgggagctaaatgatgagaacacatggacacagaaggcaacaatgaacactgggtcctacttgagggtggaggttgggaggagggagaggagcagaaaaaaataactattggttactaggcttagcactttggtgaggaaataatctgtacatgaaacccccatgacacaagtttacctatatagcaaaactgcacatgtacccctgaacctaaaagttttaaaaaaaaaaaacaaaaaagagtgaacagtactgaagtgagagtggcaggggtgcggttttcaattgcgtgctcaaggaaagctgcttgtctgggaaagcaatatttgaacacagcctgaaagaggcgagagagtgagccacgtggataactggaggtacagcaggccagacagaggcaacagcacatgcaaagtccctgaggcaggcacacgtgtggtgtactggaggaattgtaaggatgtgggatggatgaaataaagtgagaaggggagcagaagcagggggagcagatcacatccaactgtgcaggcgtagtaaagaacccagcgtttactcacaaggaatggtgagccgccaaggttttgagcagaagcgtgacatgacctgacttgcattttataggacctcccttgctagtgtctggaagagatcaaagtggatgagaacaaaagcaaggcagccattgaggagggtgggacagttacataggtggattgagccagactggtagcaatggagggatgagaaatggttagtatccgcaggggtttgaaagggctgactgatttgctgatggatggtgtgtgtggttcaagagaaagaaaagtcaaggaagggccaggcacagtggctcatgcctgtaatcccaacactctgggaggccaagacaggcggatcacctgtggtcaggtgtttgaaaccagcctggccaacatggtgaaatcccgtctctactaaaaatgcaaaaatttgctgggcatggtggtgggcacctgtaatcccaggtacttgggagcctgagacaagagaattgcctgaacccaggaggcagaggttgcagtgagccaagatcgtgccattgcactccagcctggacgacagagcgagactccatctcaaaaaaaaaaaaaaaaaatagctgggtgtggtggcatgtgcctgtaatcccagctacttgggaggctgaggcaggagaatcactggaacctaggaggcggaggttgcagtgagccaagactgtgccactgcactctagcctgggagacagagtgagactctgtctcaaaaaaaaaaaaagtcaaggaagatcaaatactcaaggctcctagtgatcatcaattagacatccgagttcttctgggaggtcctgtttgccagtggtcatcctgtcatttccatcagtgatgtctggaaggtttgataccaagaagttacctcctttcaaagtggcttcttcttccagctactaggtttgacctcctggaggccaggagtgcaaggtacaactattactcttccagaagaggctctccccaaccctcccacattgaagggttgacattgaagtgttgaagttttccttcagcctggtcattgctcaaaggtggtagaatatagatgtaggtcagtagtgatagcaggctacagccagccggtggtcaccacagggtagatatcacatagtggttgaaactgaaggcggctgaaacctgaattctaattaatttctttgtgaccatgggaagttatttcacctttccgttcttttttttaacttttaagttgaggagtacatgcacaggatgtgtaggtttgttacataggtaaacgtgtgtcaaggggagttgttgtagagattatctcatcacccacacattaagcctaatattcagtagttatttttcctgatcctctccctcctcccatcctccaccctcctggtgtgtgttgttcccctctatatgtccacgtgttctcatcatttagctcccactatgagtgggaacatgtggtatttggttttctgttcctgtgttagtttgctaaggataatggcctccagttctgtccatgtctctgcaaaggacatgatcttattcctttttatggctgcatagtattccgtggtgtatacataccagaatttgtttatccagtctatcgttgatgggcacttaggttgattccgtgcctttgctattgtgtttcaccttgttgaacatcagttttgtgagctataaaatgggggtaatccattctctacctcgtaggattgttcagagtatgataaaacactgtgtctggcacaggaatgtcaatgatcagctattgagtaagcaaagtgaattaatgatctttatatgccatgtgtcatgtaattctatcctctcacttccaggagatttggaaggcagccaggagtccctctttcctctctgttgcctggctgacctccttcctttaaaacccttctcctcttttttgtatcataatgaccttattttgaattatggtggtactttaaattttatgtccctgaagggttaagctctatgttggctttacctgaactctctcatcctcacccaccagcaagatgaaggtagggtggccactgacaggtgacgttcgtgaggtgcatggcttttctgaagataagcagtaattgaaggaggagaatcagatttaaagcctggggctgcaaggatatgagattcatcacaaatgatgatgatgatgatgatgataggaacattaggggaggagcaggagtagggggagactgggagacacaaaacatgtgttaccagactttgtcagtagcatttttcatggtttcacatttttaattctcacaatgaccctttcaggtagcttctatcattgtcccaggttccagttgaggaagctgaggctctatgaaatcagataacttgcccatggttacacagctactagtggtggtgcagaattgggaagccaagcagccttggctaaaaagcctgcagctgtgatctatgtcctcgctctggccctttctcctggctttcctgatctcaccgccgcccccttacccccactccccagcatgtccctcctcggccgtgggcaacccctccttctttggggacacacctctctcaccaagttgtgtttccccaaggcctttgagggtcacagtagtacatttctcactttgattatgaggggatacaccctcttaatctaagacaaaccaccaccaccattatactgaatttaaaccagtcaagaagttcaacccttccagctatggaagccaaggtatgttctcactttgtcttggtgcatttgatttctctgaagataccctcagatgctctaatttgagaaaatactagaaagtgtgcatttacaggtgaccatccctctgctctgttgtgacttttataaggtctagttgttcttgatatgcagactaatctgtaaggaagatgagcatgggggagagaagaaagacgcattattcactggaaaacagcatcgtgtattttagcaaggagagcgtgctggtgttgatctgatatcaccccaatacttaggaggaattgagttagagatacatttgtagcttgaagagttgcttatttgataagttatcggagtgtgtttcaaagacattatgcctatgtgaaagtaaagatggagttgtttatctctgtatctccttgtcctgtttctcccaggacttggcagaactcttgatggcaagaatctaatctttgtcctacttgtaactgcagtgcctggcagtttgccctgtccatattcatagagctaaagaaacatttgttataaatgaagaaatcccccagagagaaagctatagagaactgacctggaacaatttacttacctgctgggagacgctagtcttgccccagatgttcaatgcctgcactggtctatttgcaggtgcaggggaggcttctgctgtcctggggaaaaaatacccatgtcttcagccagccacaattcaattactctagaccagtgtatccgaagcttgagtgtacagcagaatccccaggaggatttgtttaagtactcattgctaggcgtactaccctggtttctaactcagttaggtatattaatttcctagggctgccataacaaatcactgtaatgttgatgtttaaagcaacagaaacttattctctagcttctggaagccagaagccaaaatcaaggtgttgccaaggcatgctccctttaaaggctccaggggaggatccttccttgcctcttccagctcctggtggctccagggattccatggcctcagctgcatcattttcatctctgcctttgtttttacgtggcctcctcctcttctctttctcaaatgtccctctgcctttctgttacaaagacatttgctattggatttaggaccttcctagataatccaggatggtctcatctcatcttgagattcttcattacatctgcaaagacacacccccacttattttccaaataagattcatgcacaggttccagggataaggacatagaggtatcttttagggagccaccattcaattcatggcagtagacctggaatatggggcctgagattatgcttttttgtacttctaacatgttcacagttgatgctaaaagttgctcagaggttggaatatgagagcttggactgctgctccaaagagagagaaaataatacaatgccttctttgaaatagcaccttttcagaagagttcttaaaatagattttatctcatgggattgatttattgtgcccattaagccagatgcatagctcttctactagaattaattttaaagttgctaacccttaattatttgcagagataggacaaaaaatgttggaagcaatttggaaatagtctttatgttcagtccataatggatgctatttacaacaatggctgtttcatattctcatataaatgatgaagctaacactcaaagccatagaccattcaaatgctttatatcctaaaaaggatacaaagaccatcagaccataaattgtgatttttcattgccatggcatgtttcaatagatggtttgtttctgtagaaagaacagttaattctggactcagatcctgaacatgctccttttttggctatgagaatttgggtcttagttttcttgtctaaacagtgtgggtgataatattttgtcctaataattagcaggcttattatgatgatcaattaagagtactttgtaaactgtcaagtgttttgaaatatgttacttctgtaatgacaaggttgaaaataaatataactggagctaattcatagaaatctgtgtactaaagatagatcttaagaaaaattttcgtccaaagtgtatttgcttactgcagccctttcagcttctcccatctgtcagatggcctttctcaaatgtgaccactatgtctctctcccatcccacatggtcttcttcagtgtgaccttgacgatctttcattgagatatggggactttgtctcatcctcttggatctcagtggatcaaggactcactcgtaaccagtagaatgatgtgtgacttctgagatgaggtcataaaaggccatgcagctttctccttgttcgctgggaatcttgcttttggagtccgtctgcttgaaagccaccatgttgtgaggaagcccaaactaaaccacgctagactctgggctccaggagagcacagactcctttgctttgtcctcaccattttaccccccgccgcatttagcacagtgcctcacacaagcaggcattcaaacagctgtgagagtgaagaaacaaaaggaggttgtacccaactcattctaatatgctctcaagtttaaatatgtgatgtaaataggacattataagaacaaacaccaaaaaaccacctatgtgttgcaaaagttaacattattaatcctctagaattgtatggtgcctaatggttacatctgttttcttaatcgttcccttataatgcctgtcttatagtactgccaagaattagaagggaaggagcatgctgaggcctagataattctgatgggtttttttttttcttttttggaaaggatttaacagatattagagaaaacttagagggagtcttgggactccttgatggccacgaaagggatgacttttaaagaaatcgatccagaaatgtctatgtggctgccctttctcttctcgttgtaaattttctcacagtgaacacaggtgttagagatcaagtgtttggctttctggtgctctgatgcaggaagtttgttttctcaggcaggcttctcagctcttgcacagtagcctatgggttgggacggctaccggatggcccaactccaggatggggtcatagtgcggagctctgtgagtggtgccccctagaggaaacttcctgaaggaatgaagcttcctgaactcatgcaatttggcaaccctgggttctccccaatgctttcaagacatagtaggttggagcaaaagtaattgcagtttttgccattgaaagtaatgtcagttacttttgcaccaacctaatacaaaccatcccatatctgtgttctccatcctttcatcctttatcacagtggggttgtgatagatccctgaaaacacaggatcaagtataggtaaatgcaagatggtacatagaatcaagtgtgaaagtgagtcccatcaacccacactctttccatttggcccagttgctgcccttgttgtttagaatggcacgtacctggccttgaaatgcactgaagcctatggggattactttaaaattcggtcctgtaagccagtctgttagtatcattgctcctactaatgatagaaattgctggtgttggccgggtgtggtggctcacaccagtaatccaagcactttggcagacggaggtgaagggatcacttgaggccaggagttcgagccagcctggccaacgtggtgaaaccccgtctgtgcttaaaaaatacaaaaaattggccaaatgcagtggctcacacctataatcccagcactttgggaagccgaggtgggtggatcacctgaggtcaggagttcaagaccagcctggccaatatggccaaagcccgtctctaccaaaaatacaaaaattggtgtggtggtgtgtgcgcctgtaatcccagctactttggggggctgaggcaggagaatcgcttgaacccaggaggcagaggttgcagtaagccgagatcacgccattgcactccagcctgagtgacagagtgagactccatctcaaaaaaaaaaaaagaaaaaagattatataaaaaattaaaaaattagccaggcgtggtaggcgtggtgggaagctgaggtgggagaatcgtttgaacctgggaggcagaggttgcagtgagctgagatcgcatcactgcactccagcctgggtaacagagcaagactccgtctcaaaataaaataaagtaaaataaaataaaaataatctgtggtttttcctcagcatgccctttatgaactgaattatacaaattatatactttaaacctcacaacaacctcatgaagtgtatataccagtaatattcccattttatggacaaaaaaaagagaaaaaaaatagaggcaccaagaggatcttacccaaggatgcgtgactggtaagtagcagagctagaatttgaacccaatctgttaaacagttccctcaacaaagaattatctcattttgtgcttgactctcaagcattcatgtaggtgaaaaacttctttagaattctctgagccaagaacctagctctttgtataaacattttttgtatgattttaatctgcactgaatatattcgtttcagtctcatattcatctggagacccctccagagcttgaggtcttgagaagtcctggggctccagtggccactaaagcaatgacttttcaaaagaaaagaaatgtttcctgagtgtagatgttgctatcttttttctttctcattgtatacttccttgtagagtacataggtgttagaggtcagatctggagggattttgtatccaggaggttaccttgaactttgatgctgtacactagcctagtattattattattgttgttattatcattactcctactattactcctcctcttgctgctgctgctaaagtagcaaaactgtctggctcccggagcgccacctattgaccatatagtttgccacctgtctcagttttgtgccatgcatgagctcatcctcaccaattattggcaagattatagaacaggacacagagtgattcaccttcagtatagctcccactagtgtgttgctcttatcccacaagaacgtgactatccaggattccttaaatccaccaggctctgagccagactgcatttaccaatccacagaaatagtgcagaccaattccttttgtgaaaattaacatatattttgtctatggccttctcttcatcacttgccccagcaagtctctcctcaaaggatagtcagtttggcatgatttatgtatgacgaacccaggtagactaccataactcactgttctcattgataaatcgttgataatatatgccttgtaagttggtgctgtttggatggcatgactaaagtcaagcattagcatagtgcccaacactcaggaatctggcagaaagtcaaaagttacaccgatcagtgtcattattagtatgcaatttcattcttagtcttcttgggatttaattgtattacctaatttatgtaatgagactatattttcttttctgtcccatttctattaaacttagatacgtccccttctccttgcttatggaatcaaatttttaaattaatttgatttgggttctattttctaatcccatcaataaccagctacaatctgcccttcaggaggacgctgcttcttaaagcatgtctgagctcccctagccaccctgatttataatgtgatatttaacaccctcagctgcttctgaagcccaaggggcaaactggttacctagcaaccacatacacacactagctcatggcgcaggttagccccattttgttataatgaaataatacgtcttgtgagaatgaaaagctaaggtacactatatgaggttagtgttttggagaaaaatgggctctttaggacagattagcaaagcaggagttgtgtgggtcaccccctgcttcacagtgactcaccacttcctagaatggaagtcacgaccttgaaatcctgagacttggaggaaatagaggatatgtttgatgtactgaactgtctttaaaaataatgtaaatttagcactttgggaggccgaggcgggtggatcacgaggtcaggagatcgagagcatcctggctaacacggtgaaaccccatctctactaaaaacacaaaaaattagccaggtgtggtcgcgcgcgcctgtagtcccagccactcaggaggctgagacaggagagtggcgtgaacctgggaggcagagcttgcagtgacccgagatggcacaattgcagtccactctgggcgacagagcgagactccgtctcaaaaataataataataataataataatgtaaatgtagaaacctttgggggagtgagcagtccccagtggaagtataatttccaggctatctcacacaagcctgcttggccccaggacatcctgttgtgatggagaacatcataaagctcctccaccaacatggaatccatagagaatattcttacctagatacaaaaagttcagtattctatcatgactttaatataagggaaaaataaaaggaaggtgatttacaataaaagaatgcacacttgaaatgttcgggcatgactacacaagaagatataatgacacagccaaatgtttgcacctatgtgtaataaatcaacttgaatttaggagaagtaagatgattcagaaatgcatttctttttttccagtgtctcttctacagaatattttctgaatcataatcattgcagattaaaaatcccacaaaaaatgttcatacaaggagtcaggctcttggctcagaaaattctgaagaagtttctcgcctccatgaatgcttaaagagtcaaatacaaaatgagataatcctttgttgggggaactgttcacgtttcagaacttttggcatcctttgctccacctgcagagagccaacaaaatccttcactaattttaggaaccaaaaaacaaatttccccacttctcagtacagccttcaatactggtctgtcatttctgcctgaccttgtttcttctcccaacacatctatccatttgttgattcattcactggttatgcttataacgttgtcattatatccttgtctcagttttcttatcagtaagggtaagcagcttcgcagaattttaggaaggattaagtgatgcgtgcaaaatacttagagcccacaagaagaacttgattaatgttgttcttattattgctgtattgaatgtatcctttagtactttctttttgtatagtaccatatggcatagatgtgtgtgcacacaccccctcacacacaaatacacacaccaaatatttcaaaggaatatatagtgaaaattcctcctatgtgcctaaatcttcctcggtacccttccccagaacagccactgtgtcttcccagaaattgtgttaagaaacaaacatgtatatccttttgtgctgtgttttgtagaagtggaagctttctgtgcagccagttttgcattgtgttcctcaccaacaggatctgtcggacgccgtgtatatagttcttcctcattctctttaatggctatgtgatgttgcattttatggatgaaccataatcctcaaaaacattcgttaggttgtgttgataacatagaaatgtctaaagcagtgaacaaagtagcccattatctcaggacccagataaccaagttaacatttttttagcaaaataaaagtagaagatgcagatgataaaagtaaaagcaggtcagtaacagtacagtaagaaaagtagaaatctcctgtcattttctgaagtcccaatccctctagctctcaaaaaaaaaaaaaatcttaacaattctatgtgcattctttcaggaaaaaagcaagatagaatatggatatactagctgtgtaagtagctgtgtaagtagctttgtaggctgaaaaaagcttatcccccatccccctggaagatgtgcaagtactaattcctggggcctgtgaatgttagcttagattgcaaaagggactgtgaaggtgtgattgagttaaggatcttgatttaaagaagttagtctgatacgcccaatgtaaccacaagggtccttataagaggctcaccagtggtcagagaggaaaggtgatgttgtcctgctggctttgaagttggaggaagaggccatgtgccaagagatgccagcagcacctagaagcaggaaaaggtaagggaacctcatgtcactagaaggaatgtagccctttggattcattttagactcccgacctccagaactgtcagagaatacatttgtgttgttttaagccaccaaatctgtgataatctgttacagccgtaggaaggtaatattttagcgaatatttttatttgcataagtaccacactctgtatgtgcactgagttgttctttactaatagtgccatgttatctaatttttcacaggcatattcctttctcccaaattaggtttacaagcaccttggaggcagaggctgtggttggtatcacgttgcattcctcccggctcttctctcagcaggaggaaatatagctgcttagttaaaaataaaaaaggattctgaaggcacacagttcaaagttagaacaggcagccaatgcgtttgatgtccttgagccacatgccctcagcccacctggatctcggctgcagctgcattgggcactcccaccttcttccagcagcttctccccgcttttccaggaccaagaaaattctttgccagcacatagtagccccaaatcaaggaagctaatgtcctcagaggtgacctccagccagtggggacaggggtcagtggatcaatgcccaggcccctgtctatgaaagggcaattctgagatgtgctctctgcaggtccccagtaggactgagctgcggtagcgcccggtggtaaccagcttagccacacagctgtaagaaatagttttctccttccttatctccctcttctgccttctcctacctgcttcctgaatctcccaccatcctcaaaagcacgcctacactcaagtctttgtctcaggctcagcctggaggagcccaagttagaatggaaccccagctctctttctttccccccccgcctctctctctgtctctctcccctttctctttttctctctctctctttctttctttcagtggagtcttgcttcatcgcccaggctggagtgcaatggcacaatcttgtctcactgcaacctctgcctcctgggttccagcgattctcctgccttagcctcccaagtagttgggactacaggcgcacatgccaccacggccagctaatttttgtatttttagtagagatggggtttcaccatattggtcaagctggtcttgaactcctgacctcaggtgatccacccgcctcaacctcccaaagtgctgggattacaggtgtgagctaccacacccagccagctctgcctctttctagctgaggattctgtaacaagccagtcttctaaaactgaattttttttgtctatcaatgaagatagcagaatctacctcaatagagtattgtacagtttgaaagagataatgtatacaaagtatcttatacattgtccatagctactattgttaaaattagtttatgactattacatcatagtaattgctttctaaaaagtaacttaatgaaacacatacatcaaatgcctgatgaaagctgaattttctaaaattggtcttggccttcaaaagatttctcattccttctaccatgtatattcaacagataattttgagcgcctactgtgtgccaggcagccctctgggagcaggaagactgcagtgagcaaagcaaacaaaactcccattttcctatgtcagatgcaagtggactcattcagcacatgctatttgcatcctggaggtatcaaggcaaagaaaacacagtttttgcctccagaggcataatcttacctcctgcccgtttatttgaaatacacacagttgaaatattgttgtaggtttatcgattttctatatgtttattaggctcctgctatatgccaagtactgtggttagcaccatcctcatataaacattatcatcttagcccctgaacttaaggaaatgtccaggctgctaaagcagatctgtgaaaaagctcagcctgctttttttcagctagactactatgactctagctcagaaaaaaaattatttctaatcactggttctaatacaaataaaatgtagtgattcattaatctccttagcctataattgcaaattgagttttctttcaaatatacctaaagaaggtaggtgcccactaaacatttcaggggagttttatttaagctgcaaataaaattagtttactcatttttaatttaattcccaggaggcattttggaaaccttccctcctcatttgacccaaaatcatttttaaaaattattgttctcctaaattgaagccctttccagcattgcgcattagaagtcttaaaactcatctgttttctttttgtaattgacttacaaatgcgtaatcgactcacaaatgtataactgagtatgcatggcattttaaaagggcagagtttccatttgcttcttgatttctttgggggttctcattttcctaagccctcttcccacaacattcccagtcattccttgggtcatctctcaggtgtcaccaccctgctagcatcttaatggagcggctgtgtctcctcccagcagcagtggcaccagaagatttagctgtgttggggacaacgttcagaatcctcatttgctgctaaagatgtacccggtctcattctcctgacacatggatgatgatcttgtgacccgtgtgactatgactgtatcactctgatcatcactagaacaataagtaatctaaataataagaaattctgcatgttccattgacaaaactgggaacactgcacacacatacacatattcacacaaaccatatacagtcacgtgtcactcaacaatgggtataccttctgagaaggtatcattagatgatttgtcattgtgcaaacatcatatagtgcacttacgcaaatctagatggtatattctgctacatgcctatcctgtatgacattgcctcttgcgcctaggctacaaacctgtacggctgttactctattgaatactgtaaacaattataacacaacagtaaatatgtgtgtatctaaacatagaaaagataccataaaaatacagtataaaatatttaaaatggtatccctgtataggaaagctcgattataatctaatgagacaactttcctatatgtggcccatcattgactgatatattgttatccagcaatgactgtacttaagtaactttaatagaagcatgaagaatgtagtagttgtcatttgaaaagggccttgctaaatgtaaccttcagttaaagcaagtcagcctagtggaggatggtggctgctcatgttgtcttatgtggatataaacctatatatccccactaagtgtgaaaagatgtcatgcaccaggaagcatgcaggagacttggtaaggagacagagggatgcagagactaagcccaaggctgggagcacaaggcttccttccttggtccaggtgtttctgcatgggaacagaagattggtgtctgcttttcagtgacgtggctgaatcagagtgagtgagtgggtggtttattgttggtttccacagatgctgatgctgaggcaagaaatcaagtcaaaattggtttattttgggaggtacaggaaacaccagtagaaaagtgaggaaataagacaggggagggaaggcagccaataacgtaaccagccagctgctttcatgagagactggagcatcgtcccaccaggaaacaataaaaaatagtgtaaaaacgcataagcttcagagaaagatatgggagctggggagtggatatgccaatcccattcttgactgattgaaggctgctgctagggacattaatcccccagcactcctgggctaccatgtgccaagcagagctgcctgctgtgcctttggggaaagccctcatgcagcgacacggggcaatggtagttgtctgccttgtgaaggagtaagacccggggctatgactagggtatcagcagagcctgctccaagaatggttaagggtttggtttgggacatgtagagttcaagcaacctgggaggcacctaggtgatgtgactcagacctctgtcaatactggctggagtttcaccatcaatattgatctgttgagtaatctacccattgtatgtgctttatagtgactgaattaccaacatgcatctgcctagcctatttccctcttcaaaatggcatctcccacacatgaaacttcctccttgattatatcaaacaggaccaataaatcattcagcttttccccagaagtgggatgttgagtggtacaatccatgatgtgccatttctcaacaaggcagatgatatttgattcttgggatatcagtaagtctgggttatttaactggctttttttctaaatcctgacttgtgtccagttgcttaaccagatttagaagaagccatgtttacatggaatttctgaattacaagctgagaaatgtttccagaagatattttaaagcctccttaagaaggctagtgggccttatttcctgtgtgaaacaacttttatcaaaatgtatttgacactgggagtgtgggtgaactggtgaaaaggtccctgagagttcgggtccctgagagttgcaagcacaaatcctgttaacaggtaataagattatgagcatagcccatgtagagcgcatggttttatcagctgaagtgaagcaccaagatgccaagttgttaatggaattcagcatctgtgtctttcatgggtctctaaatagacaaggttcaatgctacccaaatttcctgcagaatcaaaaccacgttcgcctttggaatgggtatttatttattgcttttactctggggaaaaaggcttttttactttataacctttttatctcttatacagcaatttccttccatcttctaaaaatgttagaaaataaagcaaatatgaaaattcatgttgcatttctaagcatctgaccacaatctatagatcaagataatgccagactctaatttcagtgtttagcaaggttactggcaaatagcatttgagaaaagagaaaaaatagtatattgaaggcaatacccaccccctatattttgtattaccatcttttgtaagctctggtcatgcaatgctatcataggatatttttccttccttcttttatgtctttttgggtcattttaaatataccccatttatatatgctactcatagaaattagttctttattctccattgaacttttctgaaaagtattataaagaaggttcaatttaattatgttcaagtaactgagtcgttggcaatcagctgccaacattttgattgttttcttgtgggattcagtcctagtattgagtgcccactaacaactgccaaatttagtcatccaaatcaccacgacaataagctccaggtattgaaacatcaagactgaagccaccacttacgatccaatcaacctttttaactgtcagtgcttccagtctttgccgaaatacacagcattaaaattcataagtcaacccatgtccgtgcgtgctttttctctcccatatccagttggtcacttgcttcatgctgatccatccatagcggtcgtggtccacactccagccctcctttacatcctccagacagatagggttctttctatggcttaaaggtgccaacctcattcctgtctcagggacctcacacaattgctcctttagcctgaaacaatcacccactaatctctgcatagctgagaccaccttgttattcaggtcttacctgaaatgtagcttcctcagagaggtcttgtctggttaccccactgaaattagcatccccctttactgtgttccattaaacctcccacttttctttcttttgaagcatttaccatcatccacaagcatccaatgtatatcaccgttgtgtggtttattgttggcttcttcattgctagaccaagagctccatgaaagcatgggccttgtctctcttgttctcagtgaaatcatatgtgctcaatatgggggttagcacatagtcaatgaatattcaaattcattcatttaaatatttaaatatttaaaaaataaatattgagatacactaccattcatttggcacacagcacatgctacttttaattgtgatggctcaaataacctatgatactgcaaagaccatttttatgcccttataggtcatgtagtaccttttgttctctgatatgtccctagtacacattacagtgtttcacacagagtaggcacttaaacataccagctagtggatagtgtgatgatgccaggaagtaatatacaagggtaggaaactaacaagtatggagcatctcatatgtgtactggcatctgacttctcatttagtcctcataacaagtttataaggtagatagtaacatcccacattacagaggaaaaacacgagcttgtaattgcatgataagcgcataaggagcaaatctggaatccaagcctgtgttctctgcagggtgccattgtgctactgacagtgtgctaagtttaggttctctgtggatgtttgtgaaggaggcacagggaggcaaggagagccacaagctcatggctctatggctggaacttcataccattaatgaccacttaagaacgtgctgaatgcacctatgcatgtggaatcatgtacttccttttcacattgtaaatgtgtctacaaaggccaggcatggtagctcactcctgtaatcccagcactttgggaggccaaggctgatggatcacttgaggtcaggagttcgagaccagcttggccaacacggtgaaaccccatctctactaaaaatacaaaaattagtcaggcatggtggcagacgtctgcaggctcagctacttgggatgctgaggcaggagaatcgcttgaacctaggaggcagaggttgcaatgagccaagttcacagcaatgcactccagcctgggtgactgagttagactaggtctcaaaaaataaaaataaaaatgaataaataaataaatgtgtctacaaacagaggtttttgagagtcaggcataagcccccaccttagtgatactgatgcagccacctcgaaatgggaggtgggtcacccatctttatttgtggtccccgaagaaagaagatctcagcggggagaaggtggggtggggcacatcaactccttgcaggtagacactctgacaagaatgtatgcactactcaaaatgtttcttacccatggttcctaatacggtgaagtcatgagcccccttaagacccagtgaaagtggaacaattccacgtgcacataagccatgcatttacgatttcaggacatctttgaacccagggcaagaactgcagctttgggaaattcccagaacagtaaacagtgtaaattctcaaaagggggtttatttcatgttacttccttttttaaagaaatgtaactgtgttgtattaccattagacgtaattgggtgagaaattacttataaacctgtcatcataacatagctattgttttctttgtccaatatattgacattttattccactgtgcacgtagagttctgcatttggctgtttttacttaatacatcatagcatcaaacagtggtaatgccatttcacagtctgtatttaattggaagtgttttagtataatgttattgtaatactcaaatgcaaaggcacggtgatgcagtgaagattggtttctgttttgtctaaaattattgtagaacccattaaattttgtaatgcacattctcttccatctacaggtctcccataaaatagcttcaaatctcacaatcaatgatattttaaagcagcacataagagtatttagctttaatgtgatcattgcctcaggctgtaataaaaacagaatttttccccaattattatcagtcactcctcctccatagtccatcatgataaaaccgagcgactttcattcctcaccaggcaactaatcatccctttgctgagcattcttcataaatggaatggaataaatttcattatgcaatgcggtaatgttccccaactagagatcggggtgtagcaatcttggggaaagttacagtcaagattattaaaatatatgaaacttaaagagaaatagtgtcctaatcatgcagcccataataggctgtgccaaccccacttatcctcaaaacagccctcccttaccttgccggcctcatctaaatgctgctgtctgcagtgcacggtggctcatgcctgtaatctcagcactttgggaggctgaggcgagaggatcacctgaggttgggagttcgagtccagcctggccaacatggtaaaaccccgtctctactaaaactacaaaaaaaatttgctaggtgtggtgggcacacacctgtaatctcagctactagggaggccaaggcagaaaaattgcttgaacctgggaggtgcaggttgcagtaagctgagatcactcaccactgtactccagcctgggcaatagagcgagactccatctcaaaaaaaacaaaaatactcttctctcttgttgtcctttgtaaacttctgaaaattagacaatacttgattcttttacttccctaacaagtacctgcttaccaacctgctatagttttatagaagtactctctgaaaaggtaccaaaaatattctcattcctacatccaatagctgtttttcttatttggttggaattttccatatgaatcaacatgctcaaccattttcttgaggatctttttgtcgtagcagttgttgtttaaaaaacaactttattaatacataattcatatactgtataattcacccatttaaaatgtgcaatttaatcttttaaagtatattcacagggtgatgcaaccaccaccacagtctgattttatatttttagaggaaacaaatatatatgtttatatttaaattttattttattgtgataaggacacttacctgagaccttaatagattttaagtgtacagtagtattgactctaggtacagcattgtatggcagattgctagaaccccttcatcttgtttaattgaaactttatgcctgttgattagtatctctcaagttttccctccccctagaccctgacagacaccaattcagtctttggtttgggttatatgactattttgagtacttcatgtaagtggaaccatgcagtattagtctttctgagactggtttatttcacgtcacataatgtcttcaagattcatccatgttgttgcatattgcagaatatccttcacttgtgaggttgaatcatattttattctatgtatgtgtcatatttatccactcatccatcactgaacatttaggttgtttgtacctcttgtgtattgtgaatagtgctgcagtgaacgtggtagctctccagtaatatcttcaaactatctcttgaagatcctgatttcaatatttttggacaaatacccagaagtgggttgctgggtcatatggtagaaaagttggttttttgaaaagataagcaaaattgacaaacccttagctagactaaggggaaaaaagagagaagattcaaataaataaaattagaaatgaaagagggaacattaccacttataccacagaaataaaaaggttcataagagacccctatgaacagttccctgccaaaaaaaatgaaaaaaaaacctaggtaacctagagaaaaatgagtaaattcctaaaaacatacaacctaccaagattaaatcgtgaagaaatagaaagtccgaacggacccataactcatagggagattgaatcggtaaccacaaattctcaacaaagtaaagcttaagaccagatgtttggcccaccaaacatttaaagaattgatgagaatccttctcaaactcttccgaacagctggagagggagtgacacttccaaactcattttataaagctagtattaccctgacaccaaagccagacaaacaccacaagaaaagaaaacaaaagaccaatatccctgataaatgtagaagcaaaagtccttaacaaaatactagcaaactgaatccagcagcacattaagaggatcacaggtcatgatcaagtgtgcatgggagtcaggaattgttcaacacacagaaatcaatcaatgtgatacaccacattagcagactagaaaataaaaaccacatgattgtctcagatgcagaaaaagtacttgacaaaattcagtgccctttcatgataaaaactctcaaaactaggaatagaaggaaagtacctcaacataataaaggccacatatgaaaagtccatagctaacgtcatactcaacagtgataaaactaaaagcttaccttctaagatcagaaacaagatagggatactcactgtcaccagttctattcaacatagtcctggaagtcctcacaggagcaagtaggcaagaaatagaaacaaaagggatccaaaacaggaagaagtaaaatgtcccggtttgtagacaaaatgatctcacatatagaaaataactgaagaacccattaaaaactattagaattaataaatgaatttagtaaatttgtgggatacaaaatcaacaaacaaaaattagttatgtttctatacactaacactaactgatctaaaaaggaaatcaagaaaacaatccctttacaatagtaccaaaaagaataaaatacacagtcataaacttaactaagacagtgaaagacatgtattctgaaaactacaaaacattgacgaagggaattttaaaagacacaaacagatagagatcttgtatagatggattggaagacttactattgttaaaacatccacattacccaaaattatctacagatttaatgcaatcagaatttcagtggcattttttacagaaataggaaactcagtggagcttcttccttctttttgactctcatgaccctgtcctcagcagattcacctgtgactatatctgtttctctttctgggtcttatctcttcttgtgcctctcatgtttaagtatctcccaatattcagttaataacattttctgttttctgtaggtagaaactgccatgcccacaggtcgagctatgacatgcatactgatgcctcccagaagtaccacttcaatctctgacctccctcctgagcatccagatttgaatttgcatctttctgtgagcatctccaagtagatgtccttcaggcactattcataggttgaaaagagtgcagagcagaaagatgaataaaagcacaaatgctggggtcaaatctctgagattcaaatcctggctctgccactaaatagctatatgtctttaagccacctaattaacctctctgtgcctaaggattctcatcagtaagatggggataaaaatacttgccttataaaattattgaaatggttatgctaaaaaaaatgtgcaaagtctttagaacagtgcccggcacatgttaagtactgtttagctatcagccataattttaaaaatagtgtttttaaaatcagtaatattattgacaaccttttctgaatattgtccaagtgctttacagggattatttcacttatcatgggaatgatcctatgagatagccactgttattattcctactttacagatgaggaaaagagaggttaattagcccaaggacacacagtttccccaagatcaaagagtcagtggtggggccataatttaaaccagggcagtctgacttcagatccacacttttgacctgggcttccctgctcaattacaaataccaaattgactccttatcttctccccagaacagcctccctttccggttttctcccctttccccaagattaccattacagcccctttctttttcacctgtgaattagcaaatgctgcacccagaatctttcctccacctctaccccattctcttcttgctgccctgactagttgaactgtcctctttatcttaacctgtcgtgacaccacctccctggtcaccgtgctcttgccttcttgccttcttgcctttccaatttatcctgctcactgacacctcagttgccatttggaaacgaaaatagaattttcagcttgataacattaaggcagagatgttgcagcaaacaaacacttcagcaggcaagacaaatatgtttcagatattttttagcagctagagaaactccaaagcaacagccagtgatttagaacagaggctcctcttacgaagcagacaggctgtagagatagaattcaaggctcagcagacatgtatctcctgttatataagcaatcagaattctcttttccaattgaacaaatccctctctgctttgatggggaaactgggatgtcagtttccctaaaatgaaaattctatttcacagcaaaatggttccagtcaactggagagagagagaaagagaaatcataactgttttcccctccccagcctagcatcctccccacccccttaacatggaaaactcctatacatcctttaaagcccagggaaaatgtgtcttttctgttgaagccctttgtcaactcttccagacactttctcctttttaatcatgcagtagaacatggcagttaggaaaatgggctctttggaaaatattcagtgttcaaatgctgattttgctattcattagctacatggctgtcagcaagttgcctcgtcttactgtgctacacttttcctcatttgaaaaatggagggcggtctcacctctctttttatatgtgattatttggaggattaaaagggaaaaattatgaaaagcatttagctcagcagctggcacttgtcagtacccagtaactgttaccagctgaattttatagccataaaataaatacaagcatcctagaaaattataatacccataggaagcatgagattttttttccaaattaagaaaaaagatatagtagtcttggagtagtttctcttcctcttaaaggaaaaataaaatgtcagactttcttacattctcataggtcagtaggttgttcctatagctatggggacaatatagtgagggtatgaggcagacttcaagttacaagttagggtttgatccgatgtcttggacatttgcttggatctgtacaaaccaggattctgtccaagaactcctttgatgaggaagtgttgctagaacttggcctatgagctctgcctgctgggaattagttttagcaaagagagagagagagagacagagaatatcatggtgatgagtgctaggacattgtcaaggctcttttaagtgtgaccaccaggggacagcaggaaagacaggagaagacctagagttcaacttggagtactgaaagccttccctttccttcttttctctctgtgaaggttgttttccttctttggggagttgcaggcccatttggtaaatgaagtgtcatatggagaattttcagcagatgcttctcttctgatagggaatggcaaagccccctaaattcatgaaacatatgcaggtgccagccaactttgcactgccttcatgacacctcatctgttttctcaaacagccaagcagcactctgtgcccttagtgaagtaagggggaataggggccaaaagggcagcgtgaagacctaactgttgtcctccctgacagctgtcgttttgtgatgctgctgcttgcttttcatgaaatctgtgaccagctccatccctatcgtgccccctgcctctgtaaccagatttttgagtctacatataggtttactgagatgacatttacttattcattgattctgtctttggaagatgcctcttccacccatacaaggtatgctgaataattggtactcagaagtgtaattagccacacatataagacatcagaactactatatgggaggcccaatgactgatcatgaatatacacagtgagagaaatgtcagtcttgtgtgaattatcttatttaaacccctcagccaccaataagttaccttctacttttacatccttagatcaggagtaagattccaagttctataatgatagccaaccaagacattacagaacaattgccatgctctaccagtagtaatacctgacatttattgagccaataatatctagaccatggctgtagcatatttcctacatagaggggaatttactcaacaccattcttgatcagctgcccaaaccccgcagtattatataaagtgacttccctgacaagttgccccaaggcattcccataagtgtactggcattgtggttatatactatgaaatatatattataaaatgcatttttctctgctcatgttttccagcaggtttaggagtcacctaaaattattgaacatcttgcttccaaacaaaataaactgtattacacattcagctctacataataacaggaatttcttttctctgaatcgtccaatctttttttttttttaaaaaaaagttttgtatgtatgtgtgttctgaatactatatgcatagattttagcttgagagaactgattaactcacattgcatcttgggaggcagattagctaggcatcagttttaaagaattagatttaaatagagggcaaagaatttcccagaaaagatgagcagaataaaaaatataaaagagaaattctcaagatcaggacatagagctaggttccatagatgctacaaattgaaatgaaccttgatcctactctcaaggaactaaatcgagctgtcacaatctctatgaagcaattgtagaggtaattaaaaatatgactgaggtagtcacaattgagagcatcaactaaggtcagtgaaaattggagcaggaggtctggctagacacaaatttgggagattcgaagcagttgaattctcaagcagcgttcagacacagagattaatgctggtcaaaggaaaaattgttcagtaccaaggacagctccctagaaagcttttattcccatagatctctgggcagagaccacaggagtattttggtagctgtgctctctctcgtaatagttcattgcacaagcattctcatgtgataatgtgtgcacatgacagcatcttttacgtaccgattaaattaccagtggtaccattatcattgtattacggttctgcagagggacagagctaataggatatgtgtatatataaaaggatatttatcagagataattcacccacgtgattacaaggtaaagtcccactataggccatctgcaagctggggaacagagaagtccatagtggctcagtccgaatccgagagccccaaaactagggaaaccaacaatgcaaccttcagtctgtggccaaaggcccgagagctcctggcaagtcactggtgaaagtcccagagtccaaaggctgaagaatgtgaagtctgatgttcaagggcaagaggaacaggaggaagcatctagcaggggaaaaagaagtaagacggaagacccagcaagcaaggttatcacaccttcttctgcctgctttgttctagccatgccgacagccagctggatggtgtccacccacaatgagggtgggtctttctctccctgtccacagtaaaagctgtgtaagtggataagattaataagggataatgtgaagggagatgagaacaagggctacatctagaacctaggaggaacactcatattccagtactggaggagaaagtggcataagtctagaacccttccagagaaggagaaaactctcaggaaagtataggattagtgaggtgaagagaagaataaatatccagaagagggttaattgtttaagctatattaagctgcaaataaatgaattccagtactagattaaacaataaataaatgtaattaattcatataaagtgattgaaggtaggcagttaagagtgtttcagcagtgtttcagcagctcatcataatattatgaatcttagctctctacatctttccaattaattatcctctgcatgttgacttcttgtccctgtgtttattgcctgatggttgcaagacggctgatgcaactctagacacatcaagatcatgttgaaatgaaatgagatgagagtgggcaatggagagaagattcatgatcttttcttccatcaggaaagaaaatcctttccagaagttcctatagacttcttatgatttttaattattcaggaccagattacatggccacccctactgttgaggagactaatgaagtatttggcttttccaggctttgttgttagcgtccagtaaggatgcaattggaaatggactttgtggtgaacagccaacaagattggccacagtggaattaacgacatcagtgttctttcagacattgaaatgctttttccataattagttcttttgaataagctgataaaatagtcaagattacccaaagcaccttctcatgaaagcaggaaacaaagttttggcaatccttagccatgatattttggttgctaaaattgatggcatttcttactttttaaaaaactgtcatatgaacaagtgtttagttcatctttttctcatatgaaagttaagttctgacttattcatgttggtctcagtttttaagaatcaatcatacagaaaagttggtagattttgtggatttatagtagaactacttagctaaaaatttgtttatcatttgaaggccatgttcccctttaattagatattctagaacctctggatttttccataatactatttttcgtaagttgtactgtataaaaataattcgttttgaagatgttgtatcattgaactaaaaatcatattaatactcatccaaagaattacacagtcattctctttaataggggaacttaagaaccagaactgtttcctatgatgtttaggagacattcagtgaattttgatcatgatgaactagaacatccaattctaagttggacactggtctcagaaagaatgctggctgcagaggtctttgagataatgaatcatctggtttcttatagtattaatgcttataattagagacagaaaagagtttaatttcttgcacgaattaattaatacttacgataaatgtcttgaaagctctttctggtgtctggttcaaaaattgcagttcttgaggtctgttaattccttctaaaatggaaaagctggtaaaggttgtgacactgctgctaaagtgatctgtgaattagaggacgtttgacttctcctctgacctctaagctcatgtggccatttgcttgcatgacctctcattgagattacccaaagttgccccaactttaaaaggaagataataacagtactttcctcatgagcctgttttgataattacataagatgcttagaaaagtgcctgggacacaatgaacactcagaaatgttgggtaggaacaatggttatgatgatcatgataaaggaggaggaggagaatttggcaattatttcctgagtacccactatatgtaaaacactatgccaaatactaggaatacaaaggtaaattagacatgcaagatttacgttccagaaagcttcatttttgtgttctctaattctgtacatgtctttcttccatttataatgtagatttacatgtaacagcaaactcactggaaatgtgtttccccccattttctgctatattgaccctgtatgtagaaataaccagggtcccacaaaaatctgttttgttttctttattgatgagcacagtttaagaattgtgtaagtcctcagtagcctctaaagtatttcaggcattttcaacatgacatgtcaacactcacccaagagaccatcttttaactaagtcgttattgaaagttctcattttgttcacttcttcagaaaattcaaagaagaaaaaaagcctaaagccactcactcgttgctctttcaatggcatcaccattgtgtgatctgtcttcttctgctagaaggaaattccaggaatccttgatctcgcatcttttaaactgatttcacagagggtatccctgacagcatttaaaaaaaaaaagcaagcaagaaaaacctcaaatgggtagaatttttctaaaagtctgaaataaaagtttataactgattttcaggtttcctattattacctaggcacacctaaatgaatacttgaagaatggggttgtaaatactcccagaggcaactgcagcaatcatgatcatatgtctgttgcagtggaattctttagtataaattattgtatattaaaccctaataaatatgtaggatcaaaacatgtgtttctggttgtggggactgcaagatgtgcaagtccccttgtccctgttctggtggcccttgagcattcctgccaatctttggaacttcagagaatgccagagttgtggggaaagataattcttactttctacccccatttccctccgtcctatggcagtctgggacgtggctgtacactataactaaactttaagacatctacaagtaagaaacgtgaataagaacttcacctgggaaaccagtctagaagagggaaatccaacatggactgaacagtctagaagagggaaatccaacacgtactgaacagtctagaagagggaaatccaacagggactgaaaagtctagaagagggaaatccaaaacgtactgaacagtctagaagagggaaatccaacatggactgaaaagtctagaagagggaaatctaacacgtactgaacagtctagaagggggaaatccaatgtggactgaacagtctagaagaggaaaatccaacatggactggacagtctagaagaggaaaatccaacatggactggacagtctagaagagggaaatccagcatggactgctgtgcaccagcctacatcatagtcacgtggttagcattggttgcatatctgcagtagcctagagtttaatcacacaagcagccttggagctttagttaatttcagttgttcaaactagttggatttatgaaggccttgccatgcccttcatcccccacttttgaagcctctcttgattattttttttaagctgctgtggtaagaggtaattctggatggaatattagttagactgaggcaaactaatataaataatattggactattaattttggaagggtcactaagccccctcaaaaataaaaaggaagaaattacacattttcataaatggttttgcaagaatgaaaaagtaatctttagtcctagacaaatgctcttggaacattattgtataatttctggttcttttctctctcgactgtagttatttcacacacattacagatgaagccactgtatcagtcagagaccaattttaatcccaaggttgattagacaggtagctcttcgcagcttgtgcactctccctttgttctacagccctacactcacacagacaaagatttacacacaagtaaggatttggcctgattcgttagtggaacatcctgatgaacacttggttgcatttaaccttttgctgcaacaaaaagtcccaaggttgccatagtaatgggaaattaaatccacagagctattccttttcccttagtggttctggcatgctatcacaccatagcatgcttacaacctcggtcaagaaagagctgtgatcccaccgtttgtccatcgagttctaagctatggtatttgtaaaaggtcattctgctctcccgacattaacctgaatggaacagctggaacgtaaattggaaggaggagtgatgattctccctttggccatttgatgacttgggaattaaatgggacccaatatgtcatctaacgttagttccagccagtgtttcagccacaggacatctcggaaaggtggtcatttggctcttgcctgaagcaatcgaggaaggagagcccagttctggaattagacaattattgttcttacccttgaaccagccacttacctgctgcgttcccactcttggccaggggccaattaatgaatgaaacaagctccctgcactcaggaggctcacagagaagatgatccagtttatgctaccgcatctccaccataactccccttttagctcattaactccctcaaaaatatccttctgctaattcctctcccttcccctctcttccactgttgcctttggagctttcactttatcctaaacttctttatgtctttagtcatctcctagaacacacatttcctcacctttagagaaacttgactctttcttcaactaatctgcagtgttcaaatatgaatacctttctgtctttccttctttctttctctttttctttcttcctttgtctctttcttcttcctcctttacttcctttctttttttctttctcccttccttccatttattcattcaacaattatttataagggacttaatatgtgcccagcactgttctaggcactacagatacagcattgaaccaccccaattaagcttgcattctactggggagaatgaaaataaaattaaaattaaaatgagatatatagtaaattaaattagaaatgcagtagggtttctttttaagtggaggtggtcctttctcctatcctcccaacttcttaactccaatgtttcaaagctaggaggagaaatcagtattcccagggaccctttggaagaacctttcttctttcaccctctttcatccattccttctctgaagctcatgccatctgattaatcacactatgttcactcctcccagcctctgggtttccaccctaatgcattgagattctagggctctggattctggttcagttttcctgtctcctttcagcatttgagtgatttctgcatccgatttgaagggtcagtttcttggttttcattattccaataatgtttctctccccctcatttgagaagccaactcataagactaaactctagtccttgctaatatgccaactactctaattccaatatttcccaccataaatctcctcctggaccataaccttttgtttctcccaattttctctctcatggaaacaactcccatggaaacaatcacacacacacacacacacacacacacacacacactcatgtggttacctttttgccagttttccagcctcctggactgaacagtctagaagagggatccaacatggactggaagaggggaatccaacatggactgctgtgcaccagcctacatcatagtctgcctacatggtgcttggcatgtagatagaatgagagatgctgaatgatagtcctcattctccctaagcccttagtgattatgagcccctcccacttgtcctaccaaacttaaacttcttattaacatgacccatctcttttctcctctcttgctgttaaggtgtgtggtgatcacagtaatggccccccaaatatgactttgtcctaattctcagaatctataaatatgtttctttcttttttttttttttttttttttttttttttttgaagacggagtctcgcttgctctgtcgcccaggctagagtgcagtggcgtgatctcggctcactgcaagctccgcctcccaggttcacgccattctcctgccttagcctcccaggtagctggtactacaggcgcccgccaccccgcctggctaatattttgtattttgggtagagacggggtttcaccgtggtctctatcttctgacctggtgatccgcctgcctcagcctcccaaagtgctgggattacaggtgtgagccaccgcgcccggcctaaatatgtttcttacatggtcaaagaaaccttctagatgtgattaagttaaggatcttgagatggagacagtgttattgactatctggatagacccaatagaatcagaagtgtccttacaagagggatagaggagggtcagagaaagagatgtggcaatggggacagcagttagagtgatgcagccctgagccaaggaatgtgggtagcctcaagaagctggaaaaggcaagaaacgaattctcttctggagcctcctgaaggtaccagccccactaacaccttgacctaacccccatgagactgatctccaacttctgacctctaaaactataaatcatcagagttgttttaagtcactaagatggtacagttagttactgcagctgcaagagactcatataaaataccagcaccactagataacacagcaagggagtgcagtgattatggtgccttgtgccttcaggattctcctccaccctcggcaggcctggtgctactaagcacctctgcacttatggtctgctgtcctgttccaccattctctttcccagcacatcaagaaccaaccacagagttgacaagaggccacttgtaacaatgtgagcttctgttcccctaatagtattaacaattacattcctgtgactcctttcagggccgtgaagatgttccttggacccaggcaaaggcagaactgctgacagctttggctgctccatgtcacctcacttgtgaatggcgacagaaaagccagggtgatctgtagctgatcctctggtcagttccactggctcaaattaaaattttagagaatcggtctctggtatatttcccctttgcagatgacacagagagggtcatttatgttcataagttggggcgaaagctccactggctagtagcagcatttgaatagggggaaatggcaccttttgactgctcatgtttattatgggaggggaaaaatgagttttattattgaacttcatgtgaccttccatgggatccaagagggattcaatgactgagaaacacaggaaaaacagcaggcagcaaaaacagtgaactagctcaagaaatatgtttttttgtttttaaaaacattggaaacatactacaagtccctaattagtttgacctccatggttagattttttttttttaactccaatattttcctgagttgattttagctttgtttgtttttccattgacaagattcatttttaattgtgttgtcaagttagagaataggattctgcttttgaaaaaagtgcttcgtggcatggagataacaataacttttcataacttgtgatgttttgttaaataacttcctgaacgagccatggtaataagtgctagcccaagaaatcagaactttggtgcttggcatgtagagaggatgagagatgctgaatgaatgagaaataagtagatatactagaaattagtccgtaagacaaggggatggatgagattctgtatcggtttgcgattctcttcttgcctttgttcctttggggaataagctacacatatttatttgttgatgttttatggaaaatctatttggtgcgtgaattctgttgttttcttgtgaagttcattgtttcaaatctccccatcttccagtgcattcaggcactattcttggtttatttgttaaaataactgttgcactgggccaatccattacatttatctttaataaccaactctaggggtttgttcggtcatcactttccctgtcaaggggcacaaatatcttctctcatccgtttcctagggggaagtatcttcttttcttgtcttgataagacagttaccaaaggaagaaagaggaaagccttatcctttgaaagatggcattaattcatgtgcatttggcagtgggagaggatattgcagtctggggtcagctatgacttaagactttctataagactggatctgaacaagccatagcatttacgagaaggtccttttgtgtgttgtgacacagactggtatcccatttatgacaagagtggcccattttctaagattggtccagagcaggacactctttgaccaatctcaaccacctgatttcctcatgaggtacaggggacttatgcaaacctctcctttaatatggaaacctctcctttgatgacccatctttaaggaaagggttagaaccttcagtctggattttattcattatcatgtcccctatgccaggctcagagacttcctgtgattatatttgttgcatgaccattacatatacactaaaagacaatgaagacacacacacacacacacacacactcacacagcattgaagatgacccaaaagagagaaaatgaagcttgagaaaaataaaaataaattacctggtctccagccaaacaacctactcagaatgctgaggggaaggtgaccagttgtggctaatctttccttagaacttgtgctctgcttctgtaacttggcaagcacaggcccttttgtaaaatacctttataatattccactatgacatgaaccacgtttttattttattttattgtggtaagaacacttaacatgagctctaccctcttaacaaatatttttgagtagacaatccattattgtgtacacaagctatctggagcttattcagcttgccaaaagctatctagagctaattcagcttgcctggctgaaaactgatgcccattgattattaattcctcatttcccctcccttcagcccctggcaaccaccattcccctctttgagtctataaattggactgttttaggtacctcatctaagttgatctggtacagacactatgggacacagtatggagtttcctcaaaaaattaaaaatagagctaccatgtgatccagcagtttcccttctgggtatttaaaagaattgatatcaggatcttgaggacgtattagggctcctgtgttcaccacagcagtactcacaactggcaagatgtggaaccagcctaagtgtttcctgacatgcactctcttttccagtttgattaatttacagtgatcatgtttgttgcatgaagattaactatacagtaaaagacaatggagaaatacacacacatactcccacacagcattgaagaggactccaaagacagaaaacagggcataaggaaaatgaataaatgaaaaacctgatttcttggcaaacaacctaattgatgggagctaaagtagttgactcttatttacttccactttattctttaacattacaaataatagactccctgaattgaaagcaaaattaaatgtgattttatcaaacctttattcttctttttgaaatcctgcttttctatgtcttatccatagaatttccaagtctctgcttgagcattttcagtggtaaagaatttacactctcatgaaagagatcatttcactgttggtaggttgaaattgtaagaaagttctttctcaacaaggatctgaaattattcctatagtttcacccagtagtcctgtctctacttaatggtagattccacattccagatttttaaaaaagtttattctgctttcttgtctactttaatctacacaccagttcttttttttttatactttaagttttagggtacatgtgcacattgtgcaggttagttacatatgtatgcatgtgccacactggtgtgctgcacccactaactcgtcatctagcattaggtatatctcccaatgccatccctcccccctccccccacctcacaacagtccccaaagtgtgatgttccccttcctgtgtccatgtgttctcattgttcaattcccacctatgagtgagagtatgcagtgtttggttttttgttcttgcgatagtttactgagaatgatgatttccagtttcatccatgtccctacaaaggacgtgaactcatcattttttatggctgcatagtattccatggtgtatatgtgccacattttcttaatccagtctatcattgttggacatttgggttggttccgagtctttgctattgtgaataatgccgcaataaacatacgtacacaccagttcttataattgttgcatagttggctgcgttgaggagacaaccataggttagagttcttttacgatcctggtcctatctccttatcatttatttcattcattcatccaagcaggagatgatggcagagaggaaacagagcagaagtcattgtgcaaatcatggaggtctttgtaggtcattgtatcagtccgttcttgcatggctataactaactacctgaggatgggtaatttataaaaaattttttaaaaaggcttaattgggtcacagttctgcaggctgtacaggaaacacaatgctggcatcttctggggaggcctcaggaagcttccaatcatgcacgaagagaaaggaggaatgaggtatctcacatggtgagagcaggagcaaaagagagcaagaggggaagtgccacacactttcaaacaaccaggtctcataagaactcactctcatgaggatagcaccaaggggatggcactaaaccattcgcaagaattcacccccatgatctaatcgcctcccgccaggccccacctccaacactggggattactattcactgtgagatttgggtggggtcacagatccaaaccatatccatcattacgtgaacttggaatttttgcagtgatacatacggccattggcagattttgagcagaggaaagagggattcatgttttaatggatccttctggccactttgttgagggatagactggagaaggaggaaggggagaaacagagaaaccaggtagaaggcttctgcaattacccagacccaaggggatagtgtcttggacttcagtggaggcagggttgctgttgagagtggtcagattgtggtatattgccagttgcacagctggaaatttcagattccctgtgacgtgggaatcttttatccacaaggttgtcatgcatttggaataagagaaatgaattaccaacatgagctgctgggacaccatggatccgttcgaggagtatcagtagctgcagtagctccttctagtgctgtgccaggcacagaactcataccatgtcatcctataatctaccccaatggtagttaatatacccctatcacagatgaggaaactgaggccaggctcagaagtaggcttcaagtggaatgtctagcaagtggcagagtggggacctatgcctacttccacgcttgagatgttcttctggggcatggagaacagtggcaaggatcccctcctctcctcaccacagctgctgtaaacagagtgggtgaaacgagcttcaagaaaagcttttagactgaacttgagaagagtgctggcctgggactggagccaccacgtgtcacttcactctgggtggagaaaggtgtagccggctctcaggctcatgcagatgtcatgagcttccccaaagggccccaagaaaattctagaaggcagagttggatggcacaggcagctgggtctctgagatgcatcttgcacacagcctcagagcatccctgatcaggaagtgcaaacaggttgctaggaatattttcctcgatttaaaaatcaccaccacaccataaatgtgtagtgttcaaagaaaacttgcatggtcctgtttgacataacatttatgtttcttcttcatggttagggttgataagaattactttcactttacaaaacagaagccatgggctaaggagtattacttatccatgctgttgcaggaggtctcctactgaactggggtagaactttccagctcccttggctctcttactgtgtcatgcttctggggaatgagaggcacagagaagccatcagcaggtgtttactgagcacctactatgtgccagatactagactagacagaccaagtccccgtcttcctggaacttactggtagagtgttgggaccagaaaggggttgccctgagttctcgtcctggctcttgtgtgaattagtccatgactatttgcttacccaacatctcatagcttcagtttcctcaactgtaaaatgagggaaataagagtgcctctgccttccccttgaggcttgttgagtagttccaatgagtcagcaaaaaatgagaaacacgaaaaagctttgtgacttctaattcagcatttatgtgaatgtgggctatcattcattactgggaaaatgcatgaccagcggataaaccacaatgaccccatgtaaagagcatcattgtttccttggtgcacctactaattttaccaaaggcagctggcctcactccctgtgactgcaagaagttttcatgttcatttttgtgagcttggggatgagggtggtttctcctattgactcaggagtgtaaccaccagaagattcattaccccagcaggaaagaaaggggagccctctcaagtccagttgtgtggacccggtgacaaatgtggcaaacaggctgatgtagattccttgaatgtaccattagctactgccatgtcacattacacttgtttatgcaagaaccgtgcagcagataagagtgtttaaatgcctttattacatggcatcatggtattggtagtagttggtaatgatttttttttcctcagtgcaaagcacactcttaatctaaaaatatgaattatgcttagtggctcgttggaaagtatttcctttgcgttgggggggaatcaatcttttctattacttatttttctttcctttctagcaaggttaatatgcagaacattatctgatggactttattttataaggtgagaggtttcccagaagtgcagtacaaggctcattactccagtgcagaataaattgtccaaagtaatttgaaggggcatcgttaatagcccagtcttctatgtacctaagctgaggtaccaccttgccgctcaggttattgagaattgtccagcatctcaacgaactctgctccagtttcaagatggaccccattagggccaggtcatggtacaacatgggagaatcatagggcttggaattttgagacctgcgttcttgtcctacctgctccatccactggctagatagccttggctctgaacctacttccccatttgtgtgacagagatgacatgcaagatgacttcctcaagggtcatattccctgttgcctctgaaatataaagcagtgtctatctctggcgtggtccagccctgccacctctcttcaccccatctcattccactctcccatgcccactgaagtgccaatgattcaagtccacatgctgaaaaatctaacctagagtccctcctccactccctccatctcaaactcaattaaaaaaagaaaaaacagatccatccagtgtgccacagtgagataccaatcagtaatcatgtacatagcccttcctcttatccctgtcttagagccaatccatgtcccagccctgccgatgtcacccctcaatatgtctgcaatctgttgttttgtctttggttcctctgctgtcgccctaaccaaggatatgccccaatttctctcttggactctttcaacagcctcatacctggcatacctgcacctatttaaaatatatatatatgtgtgtgcgtgtgtgtgtgtgtgtgtgtgtgtgtatgtgtatttaaaataaacccctattttatttatatatataatatataaatatattttatttatatataaaacataggggttttatttatataaataaataaatatatatatatatgtatatatatacacacacacatatatgaaggaacatagggtttggaattcagagagagatatcgagagagtttcgctcctgtttttctctcaggctgaagtgcaacggcacaatctcggcttactgcaacctccacctccccagttcaagtgattctcctgcctcagccacctgagtagctgggattgcaggagcctgctaccatgtccggctaattgtatttttagcagaaacggggtttcgccttgttggccaggcttgtctcaaactcctgacttcaggtgatcaacctgtctcagcctcccaaagggctgggattacaagagtgagccactatgcctggccccctatttgacatatttttaacggtgtaggcaaaatgatcttttttccaaacactgcaatcgtgtcatccccttcaaagccttctgtggctccccgttgccccaaagcaacatctaactctgatgtggtccagccctgctgcctctctgatgtggttcagccctgctgcctctcttcactctgtctcattccactctcccacgcccactgtagtccaccctggtctccctgaacgtgccacgtgctctctccctgatctcagggtctttgttcatactgttctctctgtctgagttgcttttccctgtacctcacatctaagtccagatgactgttgctcagcctccagcttcagctcagctgtctcttcctctgataaatctttgctgtgtccctaggagaggccaagccactctgttactccctctctccgtgttcactagagttgtccttctgcatttcctgctgtctctggttggctgtctgtctccctcattgtattgcagactccgctgtgtgaagagaggaattgtgtggctaacaccaggcctggtacatagtagccactcagtatggggaatgaatgtcttacttttttaattcttcaatttaaaaagctattgagagtttgtccatgatccccaaggatacatttgacaatgtctggagggttgtcatgactcagggatgctagtggcgtctcgcaggtcaaggccaggagtgccgcttcatatcctgtagtgcaaagggcagcacccgtcacaaagaatgatttggttccaaatgtcaccagtggcaaggtggagatgccctgctctagaaactgccaaagaagctgttgccaaataaaaactatagggaacaatgcaacaaatgactcttgatctaaattccatttcattggttgtttcattctggggcaatttcgctacatatgtttcttcatattggagcttataataatgcttatgtcatagtaattctgaaggagttgtcttttttaaaaaaacgtactctctctagaggctggagagggaggatcgcttgagcctgagagttcaaggctgaagtgagttatgacggtaccagtgcctcaagcctgggtgacagagtgagaccctgaatctaattaaaaaaaaaaaattatacaatgaataatgacccaagtactgtgttgtcttcatgccatggacaccttaatgctttcttcaaagcagtatgaggttgttaatctgagaatgaatctgttagccttccctgaactcataaagtttgcttcctctttgaaagaacttagtgccttttaatgcctatgcagccgtgatgtgccaagtaatatgttccatgtgtaatcccagttttctgatagtaaaaagaaaagttggaaacctttggccaactttggtgcctgtggctgggagaccttgcagaggttttcaaggtctgctgtgaatgtatgatttagaccacagctcagttgtgacatttaatccatagagataaatcatcacctgccattggtagggctctttatggataaacaggcctaaaatagttacctgtaaaactccatcagagtctccatcagaaatcaccaccatttttttttaatgtaggagactgggatggtgaaactctttcttgattttggtgcttgagaacaaattaaatcaaagtcaaaacaactaactttcccttggctgtccttgaggcatgcttggtactgttttgtttgggtttttttttcccagtagtaggctggagttcttatggatttgattctgacatcagcctcccaggagaggccatggtgtataatggttaaaagcacagagtccagaaggtgactctcatttatcagctgtgtgaccttgggtgagttacttgacctctctgtgtctcagtttccttctttgttagatcggataatgatagtccttacctcatagaaatattataaatatgaaatgaattaatatccataaagcgtttagaacagggaacgtactcagcttaataatgtacatattcgattaataagataaaggctggccgggtacggtggctcatgcctgtaatctcagcgctttgagaggtcgagtcaggtggatcacctgagatcaggagatcgagaccatcctggctaacacagtgaaaccccgtctctactacaaatacaaaaaattagctgggcgtagtgggacatgcctgtagtcccagctactcgggaggctgaggcaggagaatcacttgaacccaggaggcagaggttgcagtgagccaagatcatgccactgcactccagcctgggagacagagcaagatcctgttccaaaaaaattaaattaaaaaaaataaaggcttcacataatatgcagccaaagtcagaaaaaaaataacattcttgactgcccttttcccatgaaccccagatccacttgatataatatgccctgatgtataatagtttggccaaagggtagaaattaatgtggaattcaacttaggagaaaaagcaaataaagattatttgttccatgtcactccaagatggccagttatcgcccaactctcttccttctgcttcctcaagatctcttccatctgcttccctccatccatcctcctggccactcccatgtgcatgctcctatcctctctgcttcagccacccacccctcaccggtctccctactctcccctgtgctagagtggactctaaagcacacacctgatgatgccactgtcctgctcaaaacccctttcatgacttaagaagcagtgtgcatcgaaatcgcagaccctagattcctttatcaaactgcctacaggagagcctgagggacttgtctgcaaagctattctggagtcagatgaaactggaatatttggtctttggtattcaccatgctccatcaccccaactgcaggaatcatttgcagctcatggacattttggatcacagggtggaagggaactgaagctccccattgttgcctaaacctaatggcaccaggtgtatattgctgacttaccttcctgtaggttgatttaggaattgaagtatgttaaaggaatacatttgagatggcacagacaatagcacctagggcagggcccggtcacagttgtctcttcataacattctaagtcgaggtatgtttattcattgaccaactccctggagtctttatttctagtacagctgctaaattcagtcattcattagtcatgttttaaggacaatggataggagacattatttaaaaagcaataatacaaaataccaagagctattcagctcttttatactagagcctgtatatagtacgttctttcccacaaatccctgtttttaaatattttctccatttcacaattataatcccccaaatgacagaatggttgtctgacaatatttcttctgatgttgaacatattttgtacgtttgagactgtgccagaaagtctatgcagcagtgacattgaaagaacagaacaatctaaactgcagatattcacagagggctgaaaacctacaataactattgggaatgttaatcatttcaaatggaggaattattagaggcagcacatttatcatgcatatcctcatcactagcttagagcacctggcatagtttttaaaggaaagggagaaaaaaaagaaacactataataatgagaaaatatgcaagatttgaagtcaggaaaatgtgggtttaaactgcagcttcttccaatagctatgtgatcttggaaagttacttctccagtctgaacctccatttcttcaactttaaaatcagagtaataatagtaatacctatattctaatgttttattggaaagaacggtgtctggcacatagcaattaacccaagcaatttacatagcaattactcgtgaaaaagaagctattaatactatttattgttattttcccactgctgttgcccttcagccaaagagcaccaggaacacatccgtaattaagaagttgggttgattgctcattgcaatgggagagaatatactatagggaactatgggatgtcttagtaaaagtgtgttagaaaagacatataatttgggcttgcattattagctgctttggcggaagggtcacaaaactgaaccatttctctgaattggttgctattcggaagcatgggtagttctatgaccagtgctaaatctcatctttaggtaggacagcctagggtgaggctacagccgtaattggcaaagaagcagctattgttttagccaggaaaggcgatggcttcggcaatgttcaggtctgtctgtgttcatgcataattacggaatggccttctttatggtctgattgactgtggtcatagagtggccttatctgatgttggtattctctgaaatcatgtttgacaggagaacaccaacatctaattaatgtcccaggccagctcctggaggtcagtggctacttttcttttccccatcatatttattcatatatttagtgagtagagtactgtcaatccttggtgtcctttctctaacaaagtccaaattctatgtaaaaaattctatgtaggtcaacaaaacttagtaacttgggtgtcaaatgtaaagaagaaaagataggctcaaaggagagagtagggctgatgtggtagagggtggacccacggtgtctgtgcaggccagggtagggaggctggctttcattttaaatgacatctgaaaagtttgtcattttaaaaagtttgcttggtcccagtaaggatggagaatggcttgttggggatggagaaaaagggaaaggaggttcaaaaagtgaagtaaagcttttatcatttaaatgtggcagcattagatgtgggtcacagagttgtagacaggcttaggacacggaaaggagtttggttattcatctggcccagttgcctcctttacatgtaggaaaatcagcactgaccaggacagatgaagtggcttgtccacacccaaatatttagttagtgcagagtggagagctccaagtgggggccagagcccagaagactccttcagccttgtgcccccaacactgtggaatgggaactgaatcagtcgtggggaggaggggtctctgcaaacgtggcaggtcacagaagatggacagcaagggccaggcacggtggcttatgcctgtagtcccagagcttcaggaggccaaggcaggcagatctcttgagttgaggtcaggagttcgagaccagcctggccaacatggtgaaaccgtatctctactaaaaatacaaaaattaactgagcatagtggcgcacacccgtcgtcccagctactcaggaggctgcggcaggagaattgcttgaacctgggaggtggaggctacagtgagttgagactgagccaccgcactccagcctgggcagcagattgagacttcatctcaaaaaaaaaaaaaaaaaagcgggggagggagattaatcctggtgcccttctagaactaccacctggcctttcttaattgtccacttggagtgtttgccaagcgaagaaaagatgaacccatgactgtgacctacctggagggtagacattctggagagcttcccctccaacaatgtcccaaatctgtgttcatccctgaacacaaccactgcagttctaggaaaccaactttctaatatatttaaggatgcttgtcaagattttattatctgttctttcatcagagagatgtttacaacagcagaaaaatttaaaaataaaaatgaaatgttttgaataagaaaataattaaattatggcacagccagggtcagtagtcatctggtcgactgtggatggatcttccagagactcctctcgcctgtcatttgttggcactcaatctctacctgttgttcaatactttgagtaccactctggtaatgaaataataagagtgatggaatactgtatatccatttgaaagatgacaattcaattacttgggaaaaacacaatacatttacaattggcaaaatacaagctctagaacatcagcttaatctatatctatgttaaatgtatgtaaaacttatgttcctaccaaatattaacagtgactttccccgattggtagaattagggatggttttaattttcccaatttttggtcagtgatattttcttaatgtttaaaaaggaacattaacagtttttatgataaatgaggaaagtttctttacaacatttttttgcatgccattccttagagttgggcagcttttgcaagctgtgagaagcccagctcctgcttttcctgatacggtttatgactcacagctgccaccaagatgtcagttagctctgtgacagtgaaatgacttcatttccctgaacccggatagaaacggtgtctgggaagagagagagtacctggtggagccctatgagtaaatgtgatgatgattcagctctggaccctatactctactccaaaaggaaatgtttcagggcatcagagggcatgaattcatgaatgtgtatacgaggctttgttcaggatatttttaaatatagaagttcattgatacaacatccctatgaggtagggattattaagagggctttatctataaggaggctgggattgagagggtttgaatgatttggcccaggtcacaccataagagctgggagcgagatgacagagtcttttttgtccacaagcaaaatagccatgcctgtacttgcagtcggaccggaggaacacacaggccaactctgacgcaaagcatggttatcaccatgctcctccaatgccacctgcgtcttagctctgggtttattattcactgagtgccttaatgggcacctatcgtttattttccctgggcctcagttacctcatccgtaaaatgagacaagaaggtatttgaggtagatgaacttcaggatcccatcagccttgacgagtgcaggattctatgtgaatctagatgagatttatccaaggacctccacatcctgcctcccacctccatgagcagctattccaaagctaccagtctggtgattcagccaaagacccatcattaaagagcacaaagacatccttggccagtatctttctggatgctgatgcttttctcctgaattgcatgtcaccttggagaactcagtgatggatgagagagatccagctttgacctggaaaactttcacattgcaagttttttttttctttttctttatagatttatagtcaatacttcagcctttctatgacaagaagcttatatttttctggactagatgtaacaaacgactttccaagtgatcagtgacatcccaagttagggctgcattttgaaattgttctttagaatctctaacttcattgggaacagtgatatcagaatgttaccttaatactctgccagaaaggcatggagaagatgtaaaatgtttataaatgaacatccagtgatgtgcacttggtaatttcattcaaagatgtaaaggaagagatactataagggacatttctgttattttgtcaaatgctattatttactgaaaaataaaatttcaccctatatgcttgaccttcagggacttattttaagatcatatggcttttcctaaacagctgaattatttagtgagattgaactctcaaagactttaaaataaagcccaccaaaataccagccactctgcagtgctacagctgttcagacctcaatctgcatatttcatctcagcagactgaagtttgcaactgaaaaatcgctcagaaaatacttatcaccttccatgccaaacgcagaaaggaatttatttgaagctgagaatgtgatagggtgggtgacttactcccacagtgatgcttagaatggtggatggagttctagctgcgtttttgctgcttcacccctggggaggccacgcctctgagaaagaggctgggaggcccttccgcaacaggtgttcaggtatgagtgaaagaatctaaggagtgagcttggagcactgcacccacagacaggaccatcattaggagcacattctcagtgcgtgttgaatgttacgaaaaggtttgatttatacatttttgacctaaatagaatttaatcaaaatgtctagagaatttttacgggttactagcccctcactttttctgaagtactaaaagcagaatcaggaattcaagattatcatgttgagtataaagcactctagtcttcctaaaggaatcagtgtcagactgggctggtggttcacacctgtaatcccagcacttaggcaggctgaggcaggaggaccacttgagcctgggaatttgaggccagcctgggcaacagagtgcgaagtccctacgaaaaaaaaaaaaaaaaaaaaaaaaaaaaaaatatatatatatatatatatatatatatggagagaaagagagagcgagagcaagccaggcttggtggcatgtgcctgtagtcccagctactcaggaggctgaggtgggaggatcatttgagcccaggaggttgagactgcagtgagccaagactgcaccactgcactccagcctgggcaacagaggaaaccgtttctaaaaaaaaaaaaaaatcaatggtacctcctatagagtcaggtgatggtgttgattatgatgatgatggcaaagacggtggtgaaggtgatggcgatgatcatggtgatgatgatgggctgatgatgactgtgatgatcatcatggcaaagatgacaatagtgaggttgatgatggtgaagataccaatagcaacaatgaagatgtggctgctgatgtgacaaagatgatgatggtgatggtgatgatggcaacagtgatgacaatgatgatgatgataatgatgaccatagtaatgatgatgatgatgacgatgatggtagaggcttacattgattgaacccttgctaggtaacagatatgttaagcacttaagccctgagtgttcattatcttatttaatcttcagcaccatcacatgaagtacatgctgtgattttcccattttaaagatattgaaactgaagtttaaactcggtaaggaacttgctcaaggacaatacttcttaaattttgctatacattagaatcacctggaaagattttttaaaatcttgacccagaggttgagtaatgtgctcaagggcacccacctgatgagtggcagaaccaggctttacaacccagtcactgagcaccagaaccatgtcctctcttgtgaagagccagtcatagtgcccaaggaattttcagggccatcattgctcatgtccctccggtgatgctgtttttaataatagtaactggcgagctggagtataatgttttgggtagcatggcagatctttgtggggcagtgtgctgaaaccagcttaaatctctgactgccgagttaatttatttcattcataatattctgttcgaaatgaaaatattctcatggttggttttgcctgaaggtataaaattccccaaatcagcaaatcagcaaatcagcgctttcctctgatgaagggggagttcacggaagactccaaaaatggaccaaaatgcctctgttcccacgttgcaggtaggaaattaaagctcttaagaaaggatggcattgtttatccatattcagaaaccacagggctgggatttttttcaaatgaggccatgctagttaattaagactttgcctttcagggattatttatattcttaatttttgatatttttcatggcagtggagtctgaataaactcacaggtgtgacctccttccatgccagctactactctctcatttaatcctcatacaacactgacatttgagtaatagttttcccattttgcagctgaggaaactgaggctgcgagagtttataatttataaaagcttttataatttataaaagcttttataatttataaaaggttttataaattataaaaggtttgcatcattttcacctacccgaatcattcttctacaaaagaagaaaagttatttcagaaaagcttcctaagttttccctaaaatgaatttctggcctagaaaatcagatcctgctgtgttcacacttggcctcaatttcctcaggcttctgggtcattaaggaggagctttatcacctggctgcagggtggaggaagccaagattctggaccgatagcctcccacagctgcgttagtattccacaaaggcgcaaccagaagatagcaaggaactttcacacttggctttaatttctctctgcacattttgttagcgataaagaccatcatgttttttctttctccaccttttttgcttttagaattctgaatagatgttttcatcacgtggctaagtaaaactggaatagctgagatttccagaattcagttagaagatctgataagcatctaaaacttgtcctaaggtagggggagaagtgtttagcttggaaatataactcggagttcccagtcttcctcaagtaggtacttggggagatactgaagtaggaggaagatgattcctacaaaccacgccgaacaacagacagttcagagatctttgtgcctcttgactcaaaaaggcaactaaaagatttctaaagcattatccccatccctcccccatcaaacttttttattgggtatagaaaaacatgaggaaggtcaggtgctgtggctcaggtctgtaatcccagcactttgggaggctgaggtgggggggcagattacaggaggtcaggagttcaagaccagcatggccaacgtggtgaaaccccatctctacaaaaaatacagaaattttctaggcatggtggcatgtgcctgtaatcccagctatttaggaggctgaggcaagagaatcgcttgaacccagcaggcagaggttgcggtgagccgagatcatgccactgcactccagcctgggcgacagagtgagactgtctcaaaaaaaaaaaaaaaagaaagaaagaaaaaagaaaaaattagaaagtaccttcactagatttagaagtaagcccttaggcatagatggtcagctgagcctttttaaaaaaggaagttgcttaatgagatcggtttccaccactcagtgttagagttttgtgcctccagttttataaaataatgtaaattattcccagccgcagagaagaaaggacagaaaatgaaaattagcagggtacagaagtccattctgctgaacaatggaagaaaaaccacacagggatttggtaccattaaactctggggcaattttctgctcatttctccatctcctctctttctggtggtaatcaaaggaacgagctccagataggaaagtcttccctgtaattaatttaaacaagttcagtagactccaattatctagtctgctacaacatggagaaatgactgggaaaggaactcctgggcaactggaatgaattccatgatggctttattaaggagtacatgtaacaaatccaaagtctttaagcttatccttttggggggcttttaaaagttatgtctttataataaaataaaagctggggaccatgtttacctctatctcaagtgttaagctgaaccattgatttatttccttagagtgatgcattactgccacctaatggtcatgtacctgcattgaaggggttaagaagtaaggaaatgatttaaatagacttaccaccaccactggtcacccgtcttaaaaaaaaaaaaaaaaaaaaacaaaaaacaccttatagtaaccttttttttttttttttttttttttttttttggtttgtgctggatgcggtggctcacgcctgtaatcccagctctttgggagggcgaggcagatggatcacctgaggtcaggagttcgagaccagcctagtcaacatggtgaaaccccatctctactaaaaatacaaaaattagccgggcgtggtggtgggtgcttctaatcccagctactcaggaggccaaggcaggagatttgcttgaacctgggaggcagatgttgcagcgagctgagatcacgccactgcactccagcctgggctacaagagctagactccatcccaaaaaaacaaagaaaaaaaagtttgatggatgaagcagatgagttactgtggatcaggactgtggaaagcccgccagttagacaagggatgttgccctcacccaaagagcagataaacaccattggtgctgtttgagctgggcggggcagatgataccagatctttagcaagatgagtttcacacctgtgtacaggaagaagcgtgtgaaaacaggtcaagaggatcctgaaataaaccaagtgtgagagtatcaaggtgacaaaagggtaatggaggctggaatgtgaagttagagataatcatttttttaaattatattaaattatattttatattatatatattaaatattgatttattttttataatttataatgatttatattaaatatcgactgtttgccaggcaccatagttaaaatgagatagaccagttctctctctcaagaagctcccacatcaagtagcccttgatgtgattcactctgtggtctgcagaagttgccccacctctctggtccccagtctcctctgttacagggaaaaagattgctctgggagttttcagaagcccctttgactcccaataggaacttgcctggagcaggtacttccaagggaatgagaggaaaagcacagtgtttagctgagataggggtaaatatggtccccatcttttattttattatagagatataacttttaaatgatagctttgtgtaggtgatagtggagctgagtgagctaaagattttttttttaatctcatgatctgagtctagctatctggagtggagcaggaaatgtggtatcactgatatgtaaagaaatcagtaaggaggggctcatttgcagataaaagggaataaaaccagggcaggcatgcagacaccatcatggtagctagacatataaatgcagagatccaagataccaacttcagcttggagggagaaacaagatcaaaggaagagggttcagcagttctgtgcatgacactgggtcagatctcttccctagaacaagatgctcaatggctgtgtgccccagaacaaggtgctcagtgtctctgagcttcatgtcactgttgtgtaaaagcagcactatgataggggcctcttcatagagcagcattgagtatctttggtttaacatgagaagagtgactggccctgtaagcttcagcagatactaactagtatcattatagctcctcctcctcttcatgatgatttatagaattggtcaatttttccagggaaaagcagtagagatgagagtaagaggatgcattcattccatgcctgcaagacagcccagctggggaaggtgaacttcagtggtggggaggagtgaaaggaatagaaaatagagatttggggaggatagggtggactggttccacacctctgagacagcaaagactccaagaagtttctgagcaaaggtcacaggacttgatgatttggaggttactgatgactttcgaaagagcagccagtgaggaatacaggattcttcgtatggagacagattacagaaagaagtcaagtgaagcaacaatatgctcctagataccgaatttccacagcctggcaatcctcaacaaaagggagacctgggctagttttagactcgagaatagatcaagggcaatgtgtgtatgatcagcaggctgcagcttccatattaacctacgttttaaatgtcttacattcctctggacaaaataaatcagcccggatggaattcgttgccacaatgatctataatgatctatgatatgtcttctcatttataatgtcaagcccttggagataggaggccctcaatgtttctttgagacctgagatgagaggatgatcaatgaaagtaaacgaagaggatcatggtaaagatctcatggtaccaagaggaaaacaactgataaacagggctcatggaagtccctgtccgctgggcaaaggagaaacggctcccttacctgatcacacatcttcgtcatgtccttcagggccccagatcctgttctaatgcagagcaggaagatggtgactttttgaaatttctggaaatatcactcggtgaatcaaagcaaattaattctctcttttagtcactctgagcctggatttccagtccttggaatttcgcttctaccaacagttctttcagagtcatttatggttctaaatacacaggatgcagttcccacatcacctcccctcataacaccatgggatgaataatcatggtgaagacaaggatctgtggccaaatgatggtttcaagtccctgttctgcaacttgcctaatgtgtcatcttggacaaatcctttatcctcactgcaccttcgttttgtaaatagggacgttaacgctgggacgtactctgctggtttgttttgaagagaaaatgagctaatgcaagggagagggagctcagaccacagatttgtgcagagaaagtgccgaataagtgacggctgctgtttctgtttttattctgcgaggaactctaatagaagaaaaagagcatttgatgactgaatcaccggtcttcgctagcagggcagaggcagatagttcccccgccccgaccccgggcccagctgctcatcactggggttgcagagttcaatgccgacatcccaactctgacccagcacggtgcctactggggaaggcagatatggataaaccacagcagcgccctgtgattgattctttgccagacggtggagaaagtgcacattcccagatagctcctgcagggaggttgcatgatgcccacaaacccacctgtgaggcccataagcctggatgttctctcttagctgcttaggctctgcccctcaaaagcggaaatgttgagtgtggagtgcagcttgttctatgaatttgaagtacgtggtccctggggttggaccagcaacaagtgactcagtccctctgagactctgtttgctcctctgaaaaatgggtggtgttgtgggggacaattttctacctgatgagctcctcatgaggatctatgtaaagggtagtatctgattcattaccaggattttgtatgctttataggcatgccaaatacagctgtatcttactttattaaatcgaacggaaaaaaatgtgaaaatcaagttgtgtgttaaatttgataaagagggccaggggcggtggcttatgcctgtaatcccagcagtttgggaggccaaggcaggcagatcacgaggtcaggagatcgaggccatcctggctaacatagtgaaaccctgtctctactaaaaatataaaaaattagccaggcatggtggagggcgcctgtagtcccagctccttgggaagctgaggcaggagaatggcgtgaacccgggaggcggagcttgccgtgagccgagatggtgccactgcactccagcctgggagacagagcaagactctgtctcacagagaaaaaaaaattgataaagagagttcatgatgtaaaacagtagttctcagccttgtgtgtgcgtcggcatcccctggagggcttgtgaaaatccatatggctgagccgcacccccagagttaccaattccataggtctgggtagagtctgagaatctggatttttaataagcgcccccagtgatgctgctggtctggggaccacacttggagaaacaccttcttcaaggagtcacatgtttctgaagcaaaggagaatcatttgtctttgtattactctgttctcacgctgctaataaagacatacctgagactgggcaatttataaaggaaagaagtttaatgactcacagttccacatggctggggaggcctcacaatcatggcagaaggcgaaggaggagcaaagttacatcttacatggcagcaggcaagagaaagcatgtacagggaaactcccctttataaaaccatcagatctcatgagacttattccctatcatgagaacagcatggaaaatacctgcccccatgatttagttacctcccaccaggtcccatccacaacctgtggcaattgtgggagctacaattcaagatttgggtggggacacagccaaaccataccactctttttttcttttgtttttgtttttgcttttttgagacaggctcttccgctgtcatccaggctggagtacaggcactatcacaactcactgcagcctcaacttcctgggctcaagagattctcccacctcagcctcctaaatagctgggaccactggtatgcaccaccatgtgcagctaattttttacttttttgtagagacgaggtcccactatattacccaggctggtcttgaactcctggactcaagtgatcctcctatcttggcctcgcaaagtgctggcattacaggcatgtgccacacgatgcccagtccattttatttcgtactgaaatattcttcctcctattttttcttttcaaactgaacatctttatattcgaggttaatttaaaatggagccttcagtgcatctggtatgtgtgtgaattggacccagctcagggattttgctcttctgtttaatctttgcttttcctgtggacccatgagtgtcaggactgatatttctgatttttcctttgtgccaaattgagcctcatctgcccggtcagccctaatgtcacacgcactccccaccgcctgagattacaggacaggagatacatttcgattcaaagttctgaaaatatgattaatctcaagactggagagagaaaagttattggaaatattttcataaaaattaatgtttatagtcaaccttgtgacagtcggtagtatgtcagcaattcaggtaaggttgtgtttgtgttttcttgtgcagaggatttagctgcctataatcagtttcatgaaaccttgctcttacatgactcatttttttcatttattcactcatttgttcagcaagtgtttatattgattacttggtgccaagttctatactaggctgtgaaaacagagacaaatatagacatcctctgttcaggcaatgagagctttgtaataagtttcttgttttttaaggacaaaggcttttatgattttagcatcacgtggctcctcactttctcggttcgttttgtgtttggttgatgttttcgttgttgttttgcttggggatggtacttgtttcctgcccagcaattcttgtaagtaagtaataatatagaataaccagatttgttgggttcctgcaaagacaaacatgatatttaaagaagcttgcaattaaatagagaaaataaacatctaaaaatagatgtacaatgcagtgtgatgaggaacaagagaagtacctcggtgaaagaaataatgtatgtgtttgtgatgtctagagaagtattcgtggatgaagtgatactggaggtgggttttggaaggagaaatctctttctcatattattagtctcagtcagtttcccctccttttgttccaggaacaccagcatttcattagacttagacccactgtaagcaaagggcttaagcacaagtccctgggggagaaactcaactctgccatcttctagctgtgtgcctttggaaatcacttaatttttgagcctatatgatggaatactactcagccctaaaaaggaatgaattgatggcattcacagccacctggatgggattggagactattattccaagtgaagtaactggggaatggaaaaccaaacattgtgtgttctcatctgtgggaactaagcaatgaagatgcaaagacataaggattgtacaatggattttggggattcgggggaaagggtgggtagtgtatgagggataaaagactacaaattgagttcagtgtacactgctcaggtgatggatgcaccaaaatctcacaaattaccactaaagaacttgctcaggtaaccaaataccacctgttccccaaaaacctatggaaacaaaaaaattaaaaataaaatgaaaaacaacattgatcatgaaaaaaacatgaataacattacaccccacacaggattgttgaaagaaacaaaagaaaatattatttaaaaagcacttagcatcgtgtctgacatgttataagcacttaataaaatcatagttgccttagttattataattatcacaatgttgatgggtgtcctacaatacgaagtggacggagtcagggctggggaattgagtctatctgtggggtgtgcgtctgtttaatggtggggttctcagatccttgcatgtacaagggcattgtgaattggctgtatgtgggcaatgttctctgccgtactcccgaacttgtttaaaaaggaaactctttatccaccatgtatctccaccatgtatctgtgagagctgggactctgcagatcacttattggttcacagcctccccaaatcagcctgctctgttcaggggaccatatgtgcctgataatgaccctgcctttgtagtccatggtcaaaagcttgccatgagtctgtagtgccagctcaaatggcatcatgctgtgctcctgccttcccaagcagggtgtgcacgcaggcaccctctgaaggctaggttctagatatcctctcatctttatctttgcaactttatcctggcttctaaggggcatgggtgtttcactgtcactatctgtggaaaaattgattcagtctgcatgttccgtgaaacactaggagattctccaaaagaagcctcagttagcaactgcaagtatgcaaaacaggtatattaaggggtgatgactcacctcagaaaaggaacctctgtttatagaaaagattaaccagaagacgtctttaaattacatccatctctgggcatagcttgtgggtgtctgagaaaatgattgagaagtaaaatctgttttgtgtgcatgatacacattcccaaataagcccaaaagaaatcaaagtgacagtttgatttaccttttttaattcagaaaataccttttcaatattgacactagaaatcagccctaattattcccctctgactttgctactttgtctttccttctcatctgtgtccacttgcttcctattgcattatatattttactttgcatttaatgtatcataagcacatcccagattgctgtatggtccttatcattataatttttaatgactgtgtaatggtccatcaagtagctgagtctaatttatttggccattttcctatggttaaacatctaggccatcgattttctgccatttttagctgtagaaactgtgttttaagaaaccatatgtagaacctaaatatgttctattgattttttttttttgatatagagtcttgctattacacaggcaggattgcagtggcatgatctcagctcactgcaacctccacctcccgggttccagcaattctcttgcctcagcctcctgagtagctgggattacaggcccctgccaccacacctggctaagttttgtatttttttagtagagaatggggtttcaccatgttgaccaggctggtctcgaactcctgacctcaagtgatccacccgcctcagcctcccaaagtgctgagattacaggcatgagtcaccatgcccagctctctattgattatttgtgaatacttcagcttatttaattttcaaagtaatctttaaaatcggagccattgttatcacactttctaagtgaaaattgatgctcagagagattgtagagtttgctcaagtctggatacctagcaggttatagacctgagacatgaacccacgtatctctgactttcagagggtggatttttcatcagtgaacaatacaacttggaccatgtggagtgagacaaggaaactggcaaggcccaagagattcactaaccccctctaaacctgcccctgatgaatggcagatggacattcaaccaatgacagctgtttctgagcatctaaaatgcagggagcctggtgtgatcactggcccacctgaggctctgggggatgagtcgcaggttccatccattgctgccgtgtctctgtttggtttagaagtggctttctccaaggacgtgaatgttcattttagtgcaccttctggattttctcctcttccctagatatttgcttttgtgtattcccacgcaggagcttcagccattgctacacgtggctccttcttgtgctcttctctgcttccagctgcgttttcctcaaaggctttctggtatccgtcaatccctagatctctaagaaccttgagctttgcaatttatccctcttcagaatcctatatgtcagtggcattggcggagtgggtggacacctggacaactgttcctgctttccattcgttttcctttgtcacttaaagtgcagggccagggcagcatctcttctgttagtggcgcagctttccctgtggacaagtctccctttccttctctgtgctagctggaaacaaatcactaattaaatttcatctctcgcagctctggaaaaacgacagactagtgcttccaattaatttcatcaacagtgtggaataagaggcatgttgcatcctgtaaagacagcagggctgaggggaggaggctcccactgctgttaccctgctgtctgtcttcagcgaggctggagttctgagcctttctcacctgcgttccaatatccagccctggcttgcttagagggtgagaagactgcatttcttcatccaccaaacaccagtggggagtcacctgtgtgccaggcaccacgagcctcccactgttgatagaacagcaaacaaggcagacacattccctgctctggagatagtgccagacaaaaataaggatgtcgggatgtggcagttacaggtgtctctgaacatttcactaaatcgaatggaccagggccaacgacctagagacaggaaagggactggttgagcacagtgaggccccgtcttaggtaaagaggatacagaaatagatcaacatggtcccgggctttggaaaaatccaaactggtgagaaagttacctgaggggtcagttgcagtacaacgtgaaagacgtcatgacagtagaatgcacggggaaccctgggttcaggggaggggacttttgccctttgtgggttcagaggcaactgcaaggaagagcagatacttgagccattttcaagagtgtgccagatgggctaatggaaggaagggcatttcagacgctgagaagtccggggcaggctatgtttaggaagcagtgaatgatgtgttgcatcagaaagataccctagggggctgggcgcagggttcatgaccgtaatcccagcactttgggaggccaaggcgggcagatcacctgaggtcaggagttcgagaccagcctggccaatatggcaaaaccccgtctctactaaaaatacaaaaattagccaggcatggtggcacacacctgtaatcccagctactcaggaggctgaggcaggagagtcacttgaacctgggaggcggatgttgcagtgagctgagaagatgccactgcactccagcctgggtgacagagtaagactctgcctaaaataataaaaagaaagatcccctagggcatgtccctgatggagctgaaatgccaggtaagcaagaggcaggttactaggggtctgatatggcttgattttgactttgggcttcatctcagaggcgatggaggatggagtccaagccaaaacacctgggcaccggcccaagctctgccacgtccctggtatgaccttggcgagctccgcagttcctttaatcactgggggtaataagagcactgacaccttacggttgttttggggattagacccaagaatacacatgaaacactcagcacgtgcctgggctttaagcgtttgataaacattacctctaattgttacagcttagtagtgtctgtgttagtattgatcaccatggtgggcagccaggcagggtgggcactgaagggctttgaagtcagaaggacataggatctattctgccttgccatcactcattacatagccccagacacgtcacttacctcccttaccccctctgcttttcaattaaggattgtgtgtgtctgccacccagccccagcttcagcacatggatcctcaataaatcacagatgttgtcgttgtcatcatcatcatctacctctattatcctcaacaacaatgacatccacagtagcaataagcaggaggagcacctaaggcagactctgctttagagagatgagttcagggcttgaggctgaaagacagggaaccagcaggccaggccatgcaagccttgcagctaaaagacagggaaccagcaggccaggccgagccaagccaatagtcactgacccactccgcatccaagatccctgaggcaaaatctgaaaacacacatgttaggaaagacatttgtctctctcccagatttctgatttgacaggtcatggcaccctaaatttgcattttcaaaagctccccagggaattttgcttttccagcaggcgtctgagaaccctcatcggacatacgcagtgatgctggtaaagcctgagcagaaacaaaagagggtcccgggggcagaatgggaggcagctctgggtctcttaagatggccctggtgtgctaagtgcaccagaggtaggaactcacccactgtcgccattacagacagaacgctcctaacagagagcttccaagaaaccccagggctttcctcgtctgctgggacgtctctgtcttcctgtgcctgctcctgctggatccaggatcccaggctggctccaactcaagatctgctgtttctcctgtacttgacacctggttctttgggctgttcctttgttgatctgttattgtttactttttagtcgcctttgaattaccaaactaagtcattcttgtagcaaaatctcaagcacagaaatgactacattaaaatgagccttccacctctcctaattcctccccaacacttcccaacatcatcgccattaacaactgtgtgtagtcctcttatattttcctttccttaaatataactacatatctacagacaggtctttgttttgatatgattttacaaacctatggagttatagaatggagttcatcttataactcatctccccccactacaaaaaatcttgtggtcatctttccatgacaatacaaattcttactattttttcatagctatggtagccttgtaacttatttactgatttccctttttcagccatcttcctgttgttttgcaaacccaggccacccagcaacaatcttctttatatactgtcttttcatactgacacttctcagtcctgttggatgaattcccaatggtgcgattgctcatttctgacattctgtctgctgatcgtgggccacagcaccggttgtctctttctctgactcaacccaagtctgatgagatttcagtttcactgcagcattgcagcaatgagaaaacatcccatcatgcactgcttctagatattgtcaagagaagggtatattattatgcaaaagcagtgtctatttacagatgatgaaacgacaatttttcatggggtttttctttttatttaacatcttaactgtcaattccaacaaacacacttgttttcctctatgactaatctaagaaccaagatggccaacagcacaataccaactttttgtttgtttggtttttaaatatggcaaaattatatatgagcttcccattttacaggtttctaagaacatcttaatgaaaataacagaactcagaaaatccactgtcattttgtccagaaatattttgttagcattgggatgcagcaatgccattgacaagaaacccatgtggaccaccttttaatgcttaatgagcctttcttcctagcatgcattccagtgggagagaggacagaataaacgtgattaaattatcggacagaaacacatgactataaataattgactctcccatgtttcatgagccttaacctcacacttcagaatgtttatttcctttatttcaaaatgtttgtttacttttctccatggactttaattaattttgcctttggcttataaacgggtgaaactaaaaacttttttatttgcatttttatcttgaagcaagctaactaattaaactttgcaatttggtttcactgtgctgtaccagagccataggaaaatggctgacagattcgcagatttgtgaccgtttttctaatgaaggagattttggaaattttgatggtttcatgtaaatgctaaaggtaaaacctgtattaagagtcacttgatcacaggaagaaaaataaccaaatgactcaactgcataaggaggtgaaaggaaggatctagaaactacataccagtaaacgtcccctgagtaccacaaaaagtgtagaatggagtatgagcattgtagttttcaatagtgttactcaactggtagaaaagaggaatgcccaaggcataattcacatagatttcagtctgatatgcaacaggttcttccatgagatgtgagggcttaaaagaaaaggtagagattgaagacgttatcttttaaaagatactcacagcacatttaattgataggggatcagtaacaagattatataaagaacttctaaactcaataagatagcaaaaaaaagtaaaaaataactaagagataaaaacagtcatttcacagaataagaaaaatgactaatgtataaaaaactgttcacactcattggccattgctaaaattccagtaacaattagatgtatttatataattttatgtcttcctgattggtaaatattaagcctagaaatgccaagctttggcaataacaggaaaacagagaccctcgctgactgctgttcagagagtaaatttgtacaacaactttgaagaacagtttgtcattatctaccaaagtggaagatgtgtaacctatccctaagataatctctgcaaggaattctcatttatgcccctgggcacagagacaagaacactcctagaagcatttctagcaatagcaaaataggaaatggcctacatgctcattgatggaagcatagctccgtacccggcagtgtgtacgtctgatgaactgcagcaaggatggtggatctccaggacatgcatatgtggaaaacacagtctgcagaaaaatacaaacagatgatttcatttatatagagttcaaaaaaacaggaaaaactattaggtttagaaacagataagaagtaaaactatgaagcaaaacaatgaataatagatttaaaattgcagatagcctgagtgcagtggcttgcacctgtaaacccagcattttgggaggccgaggcgggaggattgctttagcctaggattttgtccaagatcagcctgggcaacatagcgagatgttgtctctacaaataattaaaaaaaaaaaaaaagttgggcatggcggcccatgcctatggtcctagctgcttgggatgcttaagcctgggcagtcgaggttgctgtgatcactccactgcactccagcctgggtgacagaattagaccttgtctcaaaacacacacacacgcacacacacacacacacacacacacagaacaaacactgcagatagccattttcctaagaggaaaggtagcaggctaagatcatggaggaacacacaggagctgcagtggtatcgtaatgtgatatttcttaagctgggtggtggatacaagtgttgactgtactatttattataccttgctatatgttgtatatgcatgtgtgtatataggtacatatacacatacatgtatatgtacatattcctatttatatataaaatatatagcttttaatggaaaagaggaagtatcagctatgtaacatttatcaggcatgaatcttatctcattcaacatttttatcaataatttattaaaatctggctcatccagagcaggtgagggatgatgatgattgaatcaggttttctgaaaggcatggacaagctccagccatgaactgattatttaatggaacagaggtgaagatgaaatcttccccttgagattcttaaaaaccagttcactaaattgaggtgagacccccgcctttgttaaacagcaattcatgcacaaacaatattggggtcttagttgacaagttcaaaaggagccttctgtacaagtgtctgcccagagagctaatttccactctaggaagagtgatcatcctgcaacagctagcatgcatcaaggtgtatcttgtatagttttctcccagcatcttgatttgaatagagagttgacaaatcaaagcatggtcagagggtggtaactagcaatgtaaaagatcagcttgtaagtttgtagctcatcggaggggaatgtataagagctatagtggaacttcgaggtttccagaagatcgattctggctctgtgtacccaagatctcaccaaagccaaacataccccagaaagcagtggcctgccttgtaaggtatgagctcaggtccctggatgtgtttaggcaaaggctgtacacctccctgtccctacatgtgtgctgaaaggtgggctccatggctccaacatcccttccacttcgtggctctcatgagtctataagagtaacccaagagaagtcaccagcagaaacttggaaatcgttttaacaggggccaagagggaaacatggggcagtgcatgactgacagctgtgctctgtcacttctacatctgccttgcagttcttcaagcagccatgagcccctgcaggcaaacctgtggtctgttcagcaggacctgtctctgctgccttagcccctgggaaagggaagcaatgctgtggctccattttcagcagcgggcaaggaaaagaacttgggttcgagagtttcacaacttgagattgaatctccttctgcctcctttcagttatatagtctcaagtgcttatcttcctttctctgaatttcagtttctagctctttaaacaagggtcagggacagcttactattgcagaaggtggtgagatcaagaaagaaattagaggcaaggtgcagtggcttacgcctgtaatcccagcactttgggaggccaacgcgagcaggagtttgaggtcaggagtttgagaccagcctggccaacatggtgaaaccccatctctattaaaaatacaaaaaaaataaattagccaggtgtgatggcccatgcctgcaacttgctactcaggaggctgaggcagcagaatcacttgaacctggaaggtggaggttgcagtaagtcaagatcatgccactgcactccagcctgggtgacagagtgagattctgcctcagataaaaagaaagaaattggagcacctggtatatattgctttctcaatgcccaaccctgaaacatctctaatactatttgttcacttactcatcaatttgtccaataaaagtttatgtaatacctagatcctaggtacctggtggcctctgagccattgggaatatgcttgtggaaatacaccctcctctcgaggaagctatggtcttgtagctgagactgatcacccaacagacaatggtaaacccagtgtgccaagctctaggcagaggataaaaccacgaagacaagcagaatggaagaggaggaaaatataacactgcctcgggaaggagtgttggggcagactttctagtgtaatgaaagatgagcagaaattatttgagatgaagcaggaacaacctggggcaggggcattgaagattctattgctgaatgaacagcagggaccaaggcccaggcgtcagatagcacagccagctggtgaaagttcaagttaagtgcatcagccaggatgggccagcttatgctgtcatagtaaagtacccaaaatgcagcgattcacaataaaaacagttcatttcttcccattatctctatcctccagggactggctgggggctcggctccatgtcaccctctctctggcattcaggctgacagagtggccactttgcagaacagcggcagtggttgtgcagaggaagatggcataccacactacacacaggctcttgaagctttcacatgaaagtggcatgcaggccaggtgcaatggctcctgcttgtaatcccagcgctttggcaggccacagcaggaggttcacttgagcttaagagttcaagaccagtctgggcaacatagtgagacccccatcattataaaaattttaaaaatttaaccgggcatggtggtgcacacctgtggtcctagaaacttgggaggggctgaggtgggaggaccacttgagcccaggaggtcagggctgcagtgagctatgatcacatctctgcattccggcctaggtaactgagtgagactctgtctccaaaaaaagcaaagaaagtggcttggagcacttcggattctgtttcataggccaggtaagtcacagggccactcgtaaatccaacaggggaagacagtgcagtccttctgtgtggccagaaggagaactagaagtatcagttgacagcactaaggaccaccacttttgtagcaggagaagggggtcgtctggagtgggagagggtgagaaagaaacatcagccagattcggaagctcctttatgctatgttctagggggattttattgttttgttttgttttgttttgagacagagtcttgccttgttatctaggctggagtgcagtggtgtgatctcagctcactgcaacctctaccgtcctggttcaggcagtctcttgagtatctgggattacaggcacacaccactatgtccggctaaattttgctgggcatggtggctcacgcctgtaatcccagcactttgggaggccaaggtgggtggatcatgtgaagtcaggagttcaagaccagcctggccaacatggtgaaaccctgtctttactaaaaatacaaaatgagccgggcgtgatggcacatccctgtaatcccagctactaaggaggctgaagcaggagaatcgcttgaaccgaggaggtggaggttgcagtgagccaagatcgtgccattgcactccagcctgggcaacgagagtgaaactcagtctcaaataaataaataaattttgtagttttagtagagatgggatttcaccacattggccaggctggtcttgaactcctgacctcaggtgatccacccgccttgagctcccaacatgctgggattacagacatgagccaccacacctggccctcctcttattacaaggataccccaaggctggacggaatgcctgccctaatccaccataacctcattttaactaattacatccgaaaagacacattctgagattctgggtagacgtgaatttggggaggaccctagtcaacctagtacagaaagtgataatgtatttttgatggggtttcaccaagttgcccaggtgggtcttgaacgcctgacctcaagtgatctccctgcctcggcctcccaaagtactgagattacaggcatgagccactagattttttactgtatctagcaagggccattgcaggatatcaagtctgggaatgacacagtttctcatttcagaaccattgaattggatacagcctgagtagtattcattcattttttccacaagcatttgggtggtgacagaaggcggcagacaaagtccccccatcacatttggcaaagagggttgcggggattcattaatcaacgagctaaacaaatgaatttgtaatgtttcagatggtgataagttgcaagagtaaaaataaagatgggataacaggagctgacagcctgttagagaaagccagaagtgttaaggtgtgaggagcgaatgggctagacagctacaaaggcgacagaagcaacataactgagtgagcttctagaattacaagagggtccctgagataaaatctatagcaacgcctagggcaggaggctttgataaacatgatttgcatctgagtttggagttggaatagctcttttgaagcactctgtccccatggacatagatgtaacaccaaccctttccaggagagtgggtaacagacaagccactcagccggttttattaagatggaaattttcacaagggctaaaataaagattcaagtcaatggaagccgcctttttaattgataagagcagctcagcagtaaaggaaataggagatgcttgatgcctgtgtcgttctagtgttggggaattatatggaacactcaaagcagacctccccatcagctcagagacaattgatggtctgtgcatgtccttgtgaggctttctgtggggtaggatgagattagaagcaaagttgcctcttttactcttctggtttcattcttcactctggcagtcagcacaattcacaggtgtatcagccgaggaagcatctcacaaactctattctctcttacttccatgccattttggcaccgtgaacttgaaatcactggtggtgttctctttaccctgctggaatcacagacactgcaagttgaaagtcacccagaggcgatctgatgttttccttcctctacagggaggagaagtctcttctgcttttcacagcaggtgtcattcaacctacacacatgtgctgaaccacaggagcttgtggtctctcgaggcaggaccaccccccgcaaccccatggtcaagcagcccctgcagtagccttgttcttccccaagacccatcacccgtcctagctgggagccacgtgacgttacgctgtttccgtttaagcatgaagtcattcaaaagttggaaggtagcacgctcccattttagaactgttgtgccaaaccctattaacctcagtaaggaagacaccaggttcaagaggctgaagaagagacccagagccagcaaaggaggcatggggttttattaggggcttacatccaggcaagagagtctagcggcaataagctggacattagaaccgccttatatacagaaacagtccagcaacagagggctggataagatttcaccttcctatgatccactgtcagcaggctagatgacataagcacacagcctagtggcagtgggctggggaggaaaactgcaaacatcatgcaatttatataacattttcccttaacacactccccctaatgacctccacctggcaaccttcatcaacccaaaactcagggcctcaatgtgtacagctcatgtcccatggaatgaaacggagtggggggctcagatgtttatcatagacaaggaacaaatctcctggtcgacctctcctggattccctagtttggaacacacattcaggtgcatctgccatcctgggtcatcccaagggtatgcttaagtcactgttatcagatgcatttaccctacaggaacaccttcacatcatgttagcccaattcctttctttctttgtatcattgcttccctttaaatctaaaaagaagattaagtcttccatgccaagccaagcccaattactacaatcagtctttatatggcagtaccccaccatctagactgccgactaacttctctcctcctgatagtctctgctttatgtattttccttaaaaaccacaggaaccagctggatccaggactccagccacaatccaagggccagagtagagggttctaaaatttctccataaaatttacttctcgatacaagaaagcaatataagccataatggctgacattccagaaaaacactcttaccaagccccggctctcagtaaactcaaacgcatctctctgctcaaacgttttgtggttccaagagaaaacaaatacaccgtgcacatttttctttctttaaagattggaaagaaatgaagaaaagacttgtcttgtccatgtttttatagaaaaatataaagcatgtctcctctgtgacagatttcttttcctgtaaatccagcaagcccatgaaagagcttatgtgtgagcggatgtcacacattcatcttccccagccactttgctgcgtttctgaaaagataacatagatgcctggagtgcagacatcttgagatttaggagctggcgccttacagctctttgtgaattgagcctagaaaacgtgtctgtttttagctgaccccaagaacagaactggcaaccgcttcgtgcagaggagtcttcctccacggagttggttctcaagaaactgacgctgaaactttctttgggcacgagacacctgtgtgcttctcatatttggacccaatgctgttccttctgccctctgctgtctgtgtcgttcctggctgcagaacacagcccccaagcagagatgctgagtcctcaggacccaacccaccacacaccggctgtgtaaccctgagccagtcacttctgttctcccactaaccaaacaaggacaataatggagtcttcctggggtccgatgtgcacactggtactcagcacagtaccctgggcagcataaacagtccgtttgacagggtgaatcaaggctttctgtcatgaggctttctgtgaggtaggatgaggttagaagcaaagttgcctctttttctcctctggttccattcttcactctggcagtcagcacagttcacaggtgtatcagctgaggaagcatctcacaaactgtcttctctcttgcttccatgcccttttggcaccgtgaacttgaaatcactggcatgatgagatcaagtcctattccttggaccttgtccatgtgatctgatttggaagaagagtctttgcagttgtgatttattgaagggtctggggatgagagtactgtggattatccaggtgggccctgaatgccatcacaggtgttcttagaagaaagaggcaacaggagagaacacaggtgcacagaagcacaggcaaggtgaaggcagggcagagagagatgtggccgccagccaaagaatgtagatagctaccaaagctgcatatggtaaggaagagacctcccctagagtgtccagggagcacagccccgcccacaccttgacttctgacctgaagccttcagaactgtgagagaccaaatatccgaaatcctaagccacccagttcgtggtatttgttacagcatccccaggaaatagatttagtgagtgaagggtgagccatttgcattagcagaacacagaactgaggagacagaaacccagccacacttgtgtgaggcgtagggcaaatctttcctagataataactcaaatcattcagactgctgcctctctgcctctccctttctgtctcttttcaccgcctctccttcccttctttgttcttgatgaagttgagctgcctataaatcatcgtcctgtgtaaagtttttaaaattttattttaagttctgggatacgtgtgcagaatgtgcaggtttcttacataggtaaacgtgtgccatggtggtttgctgaacctatcaacccatcacctaggcattaagccctgcacgcattagcccagtgtaaactttgatctccctttggatgccagctgattctttcttccattgcccgtgggtttctgattgcccaccattgctaaagcgagttgtataggctgcaggaacaggtgcacaggactctacggctttccctggtatatcttttctctgctgaggtcagacttttagatggcaatactttttagttttgctgggccagatgtgtttccaggaggtggaattcagcagaagcagaaagttcaaggccgtggaagatagcagttcaagtggcagctgctaagggcttttcaactcagtgttttttcagcttgacttgcaaatagagcctgaaagttcccaactcttaaaaatgttcagtgtgtccagtcttatagcaggaggaagaatttgaagatggccagtgttgctgtttctcaggccctaatatttctttgtgctcagtgaacgggcaagttatcctgaggaagaaaatatttcagaggcttcagtgctaagtattaatcaaataggtcgggggtcgagcaggccttccacagtcattcatacaggaaaaacatattgaggctggccccaccctatatctcagcggggaataactaaagctattcaagagtcaccttacatccacggtgagccacatttcctgataccagatgctttcagggcaaccttgatcatgggtttttgtctattgcatcttcatgctgcaagaaaattctgtgtgtaagcatctctgtctcccagcaaaatgtggccagtggaaggtccacatgaggccttttcagtctggcatccacagcactagcacagggcctgccacaaaataggcccccataaagactggggttgaataaaatgcattgtttgcaacacgtaggcatgatttcttctttcctgcggtgggggatgggactgacccatcaaagcacatctcatatttgaaatgtatgagattcttggatagtgcaaaatacaatgtgtgcattacacactgaggaggctgctgcagtttctccaaacccctacaggctgggagacttttaagagacccttagacagtgtcacctttgtttatgcagttttcataaatttcttttacttggccgtagtctctgggtgatacttgttgtaacaggcaactattacagtacaagatatcctgcttcagatctgtgcagctctcctgggctcttagttggagtgaatcaaagcccctgcacacacatacacctgtgtgcacactctcgctttgacattcacctatccctctacttcccacctccagaaccctctgctgctggtgtttttctgtgtgtttgttttagatttttgctttttttagagaaaggtgtctcaccatgttgcccaggctagtctcgaactcctgagctcaaacaatccttccgcctcagtctcccaaactgctgggattacagatgtgagcactacacccagccaatctctgctgcttcttgctcatggcaccatccctttggctatcaaaaggtagctctcctggccatccctttgcataggccatagtggaagcttataatttgatcttggttttttcctttagctttgtcctttctgaaattcttcattttagcctagattcctcttataatagagcataacattccagcagtgctcaaggatgattcattgcctcaaagttgccacctctgaaagagtgtaatatgtccaccctactcattggcaggagggagaatctgattcttctaccccttctgctgctccaaatgataatagcagccaccacaaccacaggctcagcagataacacgcctagcccagagctgcacgtcctctgcctctcatttgcccaccacagatacccaataaaatagacaccgctagtatgagcttccttttgtggctgtgatgaattgctacatatttatggtttaaaatgtgcaaatttatctttttacacttgggtcagaagtccaaaatcggtctcattgggttaaagtcaaggtgtaggcaaggctggttccttccagaggctccaggggagaatccactttcttgatttttccagcttctcgggtcacctgcactccttggctcctgacgccttccttggtcttcaaagccagcagtgtggcgtctccagatatctttctttgacttctgcttccctgttcacatctccttctctgactcccatgtctctctcttacaaggaccttgttgggcccacccagataatctaggataagcccctcatctcaagatctttaatgacattgactaagtttcttttaccctgtaagataacatggtaagatattcacagttgttggggattaggatataggaatgtttgggaccattatttttctaaccaccctttttttttttttttttgagacgtagttttactctgtcacccaggctggagtgcagtggtatgatctcagctcactgcaacctccaccctccgggttcaaatgattctccttcctcagcctcctgagtagctaggactacaggtggctgccacagcgcccggctaattttttgtatttttagtacagatagggttttaccatcttggccaggctggtcttgaacttctgacctcgtgatccacccgcctcggcctcccaaagtgctgggattacaggcgtgagccacctcgcctggcctttctaaccacacttttatgcctgcctttgtaactgtgaagcgacttttgcagctcagagaggctgccccatgtgtccagcctccccagtgagtaaactgaaggcagggtttgaagtaggcaggatttgatcttggaacctgggctctaaaccactactacaccatatgctcacccgagcagtgcctaaatacccagcttcttagccaggctctcagcaacttgcaaggaagagtcatattttaattacctcttgagtctcatcgagcacatggaggagaccttgggatattgttgaggcttaatattgagttaaaatggtgattgtctcccttgtacaaatctacttctatttagacaacctaaggttactttggttttaaaaaatatcatttcacactaaccttgctttcattgaagacttctcttctgcttctttatcaaacgtggtgcttctgggccatgcctctcccgtcttttgataacaacaatattctcagagaacacagtgtcctgggctgaatgttacatgtagtcactcacttaatccatgcaccaaccccatcaggtgaaaaccattactgtccccacttagtaccgttatacctcaggctcactgttgtccagagtggagcagctgttcagtggcagagctgggactgaaactggggactctgtctcctgtgggcatgctgctaaccctctgagtattgtgagtctggatgggaggccagtggggatttatgttagacggtgccctgtggttgcaacaaatgaaaaccaacccagactttctttaacaaaggggaattgatgaatagatctctcccctaacaagaggctggagatatgagactggggagagcaggagccatgatgactctggagccctgaggtcggccccgggagctggcttgtagcagaggcagtggagtcagggcaccgccgctcaggggcgggactcacaaccccagatccgagggagcatctagtgcagctctcttaagttgtgtccattggcccttggggtgtggggagcaggtgcctttggtctctcttctgccaggttgtttctaagagaagaacattgcaatctggaaaagcagtattattgtagggtagaaatgaacacatggggaagagcatttaaaaccaaaaatgaaacagattattcatacagagtgtgccagaagctactggatcgaatctccttttgctccttaaatatttattgagcacctactgtgtggctggccctgtttcattcagaggatacgagggtgaatcaaatgtgcattgttaagttttatggatctaagttatcccttgagtggtggcctgatggcttggaagaggtaatacatctgtcagttctgacatccacggtggagagaaatgaatcctgccaaatggaaatgactctccagttccatgggggcacaggtggcctggaaaaagctaccccagtctgtgagcccagacagtccagaaggccccctcttagatctcaatcccagcgcatttaatttcagttttgtgtgaccctaatagagatccttcatcaagttttattcttcataaaagatccatttccatagactcataaagcaactccttctaattcagtgttattttatacatactttcattgctcgcatcaatcacaggcagccgacttcccagccatgaaacaacagcttgcaacatcaccatgttacccaatatgtatttacttatcaagttggagaacacatgtttgcaaaatcagcaacattacagctttactagcaatttgctagcactttcttcccgttgaacacggagtctgaattgtgtggtatttcactatcctggctcatttgtatcttgtaactgcagtagtcaccagcaccctgaaacctcctggagatccttgttgatcatacctggaacttcagccaggtcacttacctaacaggtgtggttctggagtcatcgatcatctgtcctgcactacaactcaaggatataggtcctatatgtccctcgggcttctggacctagcctaaagatgccccagacaagctgtaatgcagggcaaggtcctcaatagccactctgtagggagaattctggaaaattatcctacctgcaaaatgtaatgtgaaatatctgacatgagctgtgtggagctgagtagggaagttgggagaataaaccacacttcctgggtttgcctctcgtctcagccacttaccagctagataactgaggtgatgggcaagcggctttacctccctgggcctcagcttccctctccataaaatgggctaatgacacctgcctcatagggtttgtgggatgattaaatgcttgcaatgccctgagtcatctgctatggtacgaaccctcataaaggttagctccccatcactcctgcaccaacttttgtattcattcaggattatgcttttgtgtgtccctctgagcccatactcagccacttgccagtagtgatgatggagtggttatttgacttccctgagcctgagtctctttcttttaaaatagagatgatctaattaccctggcagggctattagaagaactatttctggtgcacagtccacacatgtatctcctcctccatggaattactgcaaaggtctcctcctcagtgccccctatattttacctgcatctttaagccaactttacacagtcataggtgtcagcccattttacagataaggaaattgagcctctgtaaggttgtgtatgttgctcagatcatgtagccagtaagtaaggtgccagagtctccatctgttcagcttctatcattccaaggattccactctcaaggccccacaccaggccagtagaataaaaatctctgggggagagtctcagacatcaagagaattttaaaatatcttcaatgagcagccagggttgcaaggcatacccccaggccatgtttgctcaacctcattctcatgtacggcccacatctggtgggtcccaccagaaaaaacaagagggtgggggaaatttagcagaagtatttcattaaaaaggaggatgtagcttagaattcagcaaattaaagcagaagccaaggaaatagcagttctctggtgtccaaagcaaggtcaagagctgggagcccgaggaataaactgtgaagccagcacagatctcccagaacagggaacccagagcttagggctggagaaggcactcccagagaaggtccaagcctagagcagtgactgtttgacttctgcccaggtacatcttgcttctcaccccatagggaaacaaccgctggaggagccaagtgttcagtgagccggtgcagttctggggccataatgatgaaaaggaaggcatgtgcattgttgcctgcgcagctgagtataggcactgaggccgagacactgagtgtccaggtgaccccctgtgtttcccaggccttccgccatctggctcctggctcttgaccacgactggctgcgtgatttgcagagcccattgtaaaatgaaaactcagggtcccttgttcaacaacaattaagaatgtcaagagggtgacaacagagcactaaacccagcacagggactgtctgagcaaggggttctgtgcaactgtgcaggtcacacgttcatgaagtccacctgctcttgagcttgccttagacaccaggtctggccgctgaagtgcaggcaagagtgctgtgtgtcgtttctgactgaagcgttcaatgagtcagcatgtgagtttgcaactctctgccgctcctgcagcagtcaggaagctgcatgttcaaggtggcctggctataagatgcaagggtctggatccctaagctgccacttggagagaggatctgccccttgaagtgaacccccaaagtggactgaatttgagtgagaaattaactttatgtgctaagccactgaaatgatagggttggactgttatctcattctagcctagcctaatatagtctatgtggtttttgttgttgttgttactgtttttgagacagggtctctctctgtcacccaggctggagtgcagtggtgtgatctcggctccctgcagccttcgcctctcgtgttcaagcagttctcacacctcagcctccccagtaactaggattacagggacatgccaccacgtttggctaaatttgtttgcatttttagtagagaaagggtttcaccatgttggccaggttggtcttggactcctgacctcgggtgatccacccacctcggcctcccaaagtgatgggattacaggcatgagccaccatgcctggcctatggtctgtgtttttaaagagcaaattgctgcgcctttgcccttaaatagatataaatgatagcgacaataagcccattgttcagaattaacccaggagttcattaatatttagtgtcagttaagtatcaattatttacctgcttcctactccagctttatattaccttaagctgtaaacgaagaaaaatgataaaaactcatcttttatttattcacttattcatgtatttattcacttgtgcatttggcaaatgtttactagactcttaatacatgcaaagcattattctggtgcctttgaacattttcatatttgtcagatatagagcagcatccttgatctctacccactagatgccaatatcacatctcctgccccagttgtaacaaccaaaagtatccccaggcattgccaaatgttccctagaggggctaaaatacccctcattgaaaaccactgctgtaaaaaggactaggcttgccatttaaaaatctcttaaattggctgggcgcagtggctcacacctgtaatcccagcactttgagaggccaaggtgggcagatcactcgaggtcgggagtttgagaccagcctggccaacatggtaaaaccatatctctactaaaaatacaaaaattagcaaggcgtggtggcgcatgcctgcaatccaagctacttggaaggctgaggcatgagaatcacttgaacctgggggacagaggttgctgtgagcccagattacgccactgcactccagcctgcactccagtgacaaagcgagactgtctcaaaaaaaactcttaaattggttaaacaaacaaaaaaaaccacaccgtgtccttttgttgtttttaagagtttatggaaaaatatattggagagttacaattacttcaggctaattcaatataaagagtatttttattattagtttggaatattaaagtttccacttaaaattgattttttgaagtgttttcaggcaacatcatttaattcagcatagagtatcctatgtctttcaaaaagaacttcatgggaatggtagataaaaagattaagtggaatttttaaggggtgtaagaaaaatcttactgtcgaagtctggataaaaggaagaaattaggacagtaaaatgaatcatgatgggggaccccagttttggccatgtgtcacctaatatgtcataaacagttcttcagcttcattaaagaatagcttaccagaaagaagggcagacactggaggctgaactgcagcgaatgaaaacctgaaataatcacaaggtggtcctgttgccatcatctctttatcagtataaaaataaacaacctttgaaaacagatggagacagtcattgctcaacttgtcataacttattacatatttggctgtcaatttgtacttaaaaaaccaactagctccagggaggcaaagcaaagtggagaggagaagcgaagcctgttgcatttcaattcaagcctgtggtaatttcagctgcatggagacacttaggactgtttttaaatgaagtcagcaactgtcccaaaatttaaggcattctcattttaaagagcacagttgtgttcctatgggatggcacttcctcacctcaaacctgtatcaggagtatatatatctcgtgcccgtttagtcagtgctgctctcccacagggtgagatctctctgagccagatcattctcggacagatgatgaatttttctgttccaaacagggaggtgggaggaggaagggcaaaatgtttcccatggatgtaccactttttaaagttgtaatctggagtactcatcaacaacatctaattcgtgcctttgggggaaagaatggctctaccaacagacaaggtcaaaagctggtgggcctcagaccgaagcttgccataacctcttttgtttggccttctagtcccactgagtgatcttttattttttaaatttgaactagtgtctaaaaatccaaattcccaccttttcttaaaaaatcaaaagatggctggacgcggtggctcatacctgtaatcccagcactttgggaggccgagtcgggtggatcacgaggtcaggagatcgagaccatcctgactaacatggtgaaacctcatctctactaaaaatataaaaaattagccaggcttggtggtcccagctgcttgaggcagaagaatggcatgaacccaagaggcggagcttgcagtgagccgagatcacgccactgcactccagcctgggcaacagagcaagactccgtctcaaaaaaaaaaaaaacatcaaaagatctggctagtccagacttgtatttcagacatgcagtaattcctttgagctaaaaggcagctgccgcctgaggcaggaggcacacgctccagtttgccaccaaccccacctctcccggttgccttgagagcgctttactcatgtgaagctacctgtatgggcactgggtgagtaggtgagcttctcactcctggcccagctcccagtctgaccacagagagtcccacctttgaggccagtggaactaggctcctgttagaggactgaccaaaggtcattagcatcttcatcaaaactcacattatcaagcactttctggatcaaatgcacagctggaccaccatatgaaaatgtgggaggggtccttgtgctggtgaataacaacccctggataactgggcaacccagggaagggccgccaaaggagcaagggttacaaagccaaatctcccagaccttgccttaggcctaagcctgcttccttcttctcttttccccaaaattgggctggaatcacctcttttctctgccactctgcagttccatcctcctaccctcagagtacaggggcagggatttctttaacagtcttcacacccagaactgagaaccaacctcccacctggctggccagtagagtcttttgaagatgagaaaaaaaaaaaaaaaaagaaaaaaagaaaaagctgaatgatgagcagtggcctccaattggacatcccctcaaatgaaaataaagccagtccaaatgtaagccagtgggaaaatgagacattatttacaattcatcacatgggtagctttccaggaacacatgccctgccaaacgtgggctgcctctggatccctatcaggttggttggttatctttcatcaactagtcattcgacagtttccctatcaattgctgtctactcaagaatgtccacaagaccagaggaagcggatgcatgcatatgtgcactcaacagaagtatctaggcttgtctaagggaagaaaggaattgtttcctaacaagattttaagtaactcctgtttctgtagatcctgagagtgagtcctagaagcagtgtgtcttaaaccctaagtggttgggtcccacaagctatttccctcgtcatgattgcactcagcagtgggtcctcacagaactgagttctaaattgtgagagtcaatgaaaataacaaacttacatttctcagctgggcgcggtggttcacacctgtaatcccagcactttgacgggcagatcacgagttcaggagatcgagaccatcctggctaacatggtgaaaccccatctctactaaaaatacaaaaaaattagccgggcgtagtggcagacacctgtagtcccagctactcaggaggctgaggcaggagaatggcatgaacccgggaggcggagcttgcagtgagccaagattgcaccactgcactccagcctggtggactgagtgagactccgtctccaaaaaaaaacttacatttctccattacttaccatcatcctggcattggactttatatagattaatttgtgcattctcaaagggggtaatattacttctaagcaagagaaagttggtcattaggagagaggggtttatcacatcagatgtattagatattacaatggcttgtgccctgcaaggggccatagcacataaatagatacacggtattctatagaattaacgttttgtgatggagtgagagggtgtcaagtcgaataaatgtctgaaaatattcttgggggaaggtgttaatggaaacacaagaggctcagagagcattgattcactcaatgcctccaacaacccatgagagaagagccattttgtcaatgaaaagttgaggtggggcgtgatggctcacatctgtaatcccagcactttgggaggacaacgtgggcagatcgcttgactccaggggttcaagaccagcccaggcaacatgacaaaaccccatctctacaaaaattagccaggcatagtggtgcgcacctatagtcccagctaattgggaggctgaggtgggaggatcacttgagcctgggaggtcaaggctgcagtgagctgtgatcataccactgcgctccaacctaggtgacagagggagaccctgtctcaaacaacaacaataaaatttggggcttaactgcccagagaagcccagcaggtgaggccaggttttaaaaatagatagcccaggtcctcagccgggccactggcttgattctgctttggttttgcacaccagggtctctttctttgttactgaggacggttaggagagaactggctcatgtccacctgcttggtcaggaaacaattttagattggtgtgtttggggtggccagttgagtgaatggctgtaggctgtgtcccaggcactacagtcacatttgcaacaattctcacattggcagtctgctgctcatgacgaagagacgtgtctacacctgaaagcaaaacttggcctgcagggtgaccacctcattctggtttgcccaggagtgtcctggaatcccctcagtcctgggagaactatctggttctcatttggaaccaggaggccccaaacccattcaaactaaagaatcttcaatggaaatttagtttccaatgagaatcgttccaactagatattccccaaaatgctagaatttaaaatagcagcttctacatctgtctcacctggctaagcaccctaagctgctgctggtctaaggcttgtcttctgacacaggggcaaacacacaagtaacgttgtgcactacaggatccatgaccacattctccttttgaagcaccactattagatcattcggtcacagaaagcatggtttgattggaattagaactcactgcctcctctggtgagtttgatgcttgacaacgatgtgccattttgtcacatcaaagaggttcacctggtgacatctgccatctctgctcatgtttgctttaacatcacacttctccctggaaagcacactgttgccctaactgtgctatcagaaatccagtgctgaatatagatctgaatgtctatgtctcaatacgtgattcgcttataggaatagcattttgtaaaaaatgagcctgacactttttgatcaggcaaaggaaatgtttagggatggagtcaaagaaatgttaagaacagcataattttgtcactgtcttttggagcatccccatcctcatggccagctgaaaaccccccgtcactctcagatctgcgctctcctttctcaaggggttggccgtgcttgaagtcacaggaaagcaaaacttcaaagctggctttcaaggtcaagaaaccaggcggcacttgctttaatgagagagctgcagtcaggaggaaggggctacctggccacaaggaagcgatcacacttgttaatcagcctgtcaggctggcggccgtgtccttcggcaaaagaaaatgacggcccaacttgagactttcaaccaggaacctgggatgttttcttccccctttggaggagctgctgctagttcatctggctcagggagtgacagggtgattataatttattttgtcactcaggagagtattgtgacgggggaaaagacagaaatgtactgtgtggaagccccaatgcgtgtctgtcatataattaccctttctctgctgtctggaaacacaagacaagcccggataggaagctgcatgagctggtgaaaacaaagtggtggacatggagtccagtgtgtgggactgcataagaggagaggcacaggcatcacccacaggcaattggagcaggtgcactgaggcccacctgctgcatgtcagccctgggcatagcattggtatgtgacccaggaatcccattccagcaaggacctccaaggcgcattgaacagggagctcagaggcagtcgtggaaaatctccaggcacgttgctcagttgttcattcttcttggaagacaaggtactggtggctctggtcagtgtggaatgaggcaacactacagtgaatggcaagaagccaattcaacccaaagaacactgatgaggacctaccgcgtgtcagacactgggcttacaaaatgaacacaacagtctataccctccaagagctcacatctaggaccatgtggcccatcacaaaaagatagacagttctgaaataaagaggttccatcaacagcaaagtttggtgagtgctgcagagagacaccctctcttggagattgatgctgtaagcgtgcttaatagaggcactgaagagtcctctggggaaaccttgctttgcggtgtttgccacgtatttcccaaatctgtttctcgactgaatctatggagccagagttcctcggaaccaatttagagaatgctggtttaggaggtttatccagcctttgcagaacacagaagtaaggaaaccatgatccagcctccaggggaaggtactggcaagagccaagcattgcactcagcagataggttggggttcaaagtaaagcctggtcttagaggccgactagaggaccacgtggagacatggtgtagactacagaatgtgtgtgtgcacgtgtgtgtgtgttgttgtgatatccacagtagaaacccagatctgcacactaagaccatgggcagggtgggagaagggacccggtgagagagagggctgtcctgcgaccctttgtcccacattctttggacaacttaatcctagtctcctgtatctgaggcctttgcctgcactgccataattggctcagaacccaggacagagttggataatgcaaggcttcctctctgaacactaatgtactaggcactgtaccaagttctgaaaataggtcatcccatgaaatcctcacaacaaccaaaggggaatgttgaaaacagggaaaccgaggctcagagagagatgaataatgtggccacggtcacgcagcttgaaaagacttgaacccagatacgtcacctcagagtcgttgtcttcaatgctgcaaacctatttacataactcaggcacaatgcggttccctcagaggcgcgatttcctccagagtaaatccagtgatgcattcgtgtctgggtgaagacaaacacggggcttaagaccgagttcacctgttccctaacaatccattaaaataaaaaccattttctgtgtatgcttgggaatattccaggataattttgtgttacatcatgttatccaacctgtaaacaaaaagatatcctcagtgaatttcctgatgaaaactaaagactcatcaacctgaaaggtcttttttttttttttcttcctctaatcattttaatgcatatgtcagttgcaagccatgatgacttcatttttataccttccatgacttcaattaaaggcagattaaatagggcacaaatccaatcaatcgagcattcattagacattaactaagtgcaaggccctgggtcaagtgtacttaactggagactggtgtggaattgatggggttaaggcctcctcctatgtctttggccacatggagctccctttagcatgtccctgggtaagatcgcaggcctgaaatctgcctctgatttctgatggggatatccttaagtttgcctagatcaggaagtttaatatgtgtcacatttcacatcagtttccatagactgtgagtggctgcctagaccactgttggataacactaattctgtagcatgtcaatgggagacagagtcatgctgttcctgctgtcttccagagacaggggggctgcatgggccaagaatgttcttttctgaagctgaaccttgaagcttgccctgagaccatctcacagggcaaagaagctaggtggataggaagtgcaccttgaagcatgtggccggatggcaccattggtgaaaatagctgagactgcctaacaaatcaatccaaccttgagggtggccagatcttcgttgtttatctgatcaatcaggcctaatgactgatactctgattccagtggtgggggaaaaaaaactggctttgatgattagagaagcattgctatggaaggaaaaggaattctgggtggtggtaaaaccagatgaattctatctttcctttaggcttcagtgttttctttgtatgactattcctgctgctttgttgaatagacatctgcggctttgatctcttccggttaggtcacactttgtgagtccagacagattcaaaatcagaagatgggccttatatttgtagaagactatattgggataaaaagttatggttaggcaggatgccctaatccaaatgtggtagcaatacaattgctattgtcaatcatcaaaaccagcaggcatgtttttgttggtgcttataattatgctctttgtaaattaaattttaattgccaaagcaatacattcaccttgtaaaaataaacaaaatgttatagatgaggccaacatctttcccgatgaccatgccaaatcccaatcccctctcttcttctccagatttaaccaccattaccagggagaagttctccttatagagttgttctatgcacttataaactgtacctgtaaaacatgtgaataaagtattgtggcatgttctgtgtgtaagcatgttcacaaaaatggtatcactatccccctgtgggtaaggaaagttaaaacgtgccacatttcacatcagtttctgtatacttcaagttgctacctagaccactgtttgagaacgctgattccatgacaaggtcaatgggaaacagaaccatgttgttcctgctgccatccaaaggcaagggggctgcatgggccaggaatgttctcttctggtgctgaaccccaaacattcctcaacctaacatttttactaattaatatatcttgaagagtttcccacattagaacccattagatctacagtctttttaagctgctgcaaaatatctcagtgtgagaatactatcattttggcaattcccctgttgatgaacagctaggctgtttccaaatttttcaccttgacagataattcagctagaaatttatttgcacagatcccttgcggacacgtgcagttgtttctgaaagtagatgccaaggaggcgaaggcattgtttttactctttgctgcccaatggtccttgacaatggatataccagtttccctttatatcagctgcatgggagggagacccattatctgacacccttatcaatcattgacataatccaacactccacatgcttgttatagaatcaggtcctatttgtatgactcttgcttgtttgtgagtgaacccaaccatgttaccctcattttatattggaagtccctaaaataacacggctgctacatagtaggtacacattagtgtttgctctcattccctttaactggaatgcctttttgctctgaggtccctttgacttgttcctgcctactctcttcttacgggtcctcatcagacacctttgtgcaaaccccagactagataaggttgttcatctctgtattcataatgccctctctcagtgtgcctgataagtcttattgtttgttatatatttatctcttctactgatttctgagctcctgcacacccaggagcatgcctctttgtactcctgtttccccaacacgcagcccaggcacatggagttggcattgaatcagagctttaaaaatgaaggccatggctagatggaatcttgtaatcccagcacccttggaggccgaggcaggtggatcagctgaggtcaggagttcaagacaagcctggctaaaatggttaaaccccatttataccaaaaatacaaatattaactgggcgtgatgacacacaactgtaatcccagctacttaggaggctgaggcaggagaatcacttgaacctgggaggcggaggttgcagtaagccaagatcacgccgctgcactccggcttgggtgacagagcgagactctgtctaaaaaaatgaatgtccctgtcacaaagccacatccacagtggaatgaaagcccctgaaaataaacagtgtatcaccagagggaaaaattaagcagtcactctgctgaacagcaaagatgttttcttctttatttcaggtcttttcatggaatgaaacagagagggaaaggaggaagaaaagctgaaacatagcaaagcttgggaaatacttttcttttttaatttggaaagtgatgggcacactgctgcactgctattgcccaggtggggaaggggctctggccgttgttgacccattgataaccattccgtgcctttctgtcttgccccggtaggcaccacagtgatgcggatgacagcctttgatgcagatgacccagccaccgataatgccctcctgcggtataatatccgtcagcagacgcctgacaagccatctcccaacatgttctacatcgatcctgagaaaggagacattgtcactgttgtgtcacctgcgctgctggaccgagaggtgagctgaaaagaatacactttctttttcacgagaatagaatgtggctttcatgcaagggatgatgtggggctccagtcagtggttttttttaatactgtaaaggcagaaatgaggtgtttaccatgttttggtggggaaaatctataaagggaaatgggatattatgtgacccaagaaaacacgtgctctaaaaggctaaagcgcctggaactgtttgtattcactcaacctgatgcctatttcctcaacagccacttattctctaggccctggtgattctagactctgcctctggcccctgctttaatgctagaagggagagggaaggacaagggaaggaggggaagggaggagaggtggcttcatccaagatcacacaggctgtccttgttgcagagtcaaatgcccatgactcctttctccaaccctttgctgcaggcatcctgcattcccccttgaacccctctcttcctccatctctgttctcatccctttaggctttctccgtgaaatctcccccgtctcctgggtcacatgtcacaaacaggtgacccctggcccagtcagtccacatgcctgctctttcgttttgcctgcagtgttttacagcttttagaattagttgtcatatcaaaatatttagatttcacgtttctgttttaaaaatgccaatttccagtttttctggacatcagaaatcctggagacatcaggtccactttccacatgtgcactatcggtggtgtgaggtgtgatgctccagtggatccagggtctgctgtcccctttagatgggacatgtgctcccacctcgattacgtttccacgtgcatgggcccctctggtcctgccctttcctgagtttgaggtccaccgtgtagcttaccataagctactttaagtagaagaccctcgcggacctccaaacacagcatccttaaaccaactcgtggattcctacccatccttcactctccatccaccctaaacctgctaccattctggaattccctgctcctgacatcatcccacaggcgtggggccttggagttgtccttgaccttctgtaagaaccatcagctccacgtaactgctgggcttccctcgggggctctgtgcatttccccctcagtgtttttgatgaaataaatccatggttcggagtgttgtttcctctgctttctcctctcttatgtgctatagtttctcaagagattctggattacatcaaccccttctaagaagctgtcctcatccacctgattcttccacagtcttgttcttcctcccatctctgactactcttgcctgtagccatcatatagcagttggcatgtgctaattaggttgtcatttgtctctgaagaagattctctttctcttggtctagacctgaattgtccagtagagtaaccactagtcacatggggttattgcaattttaaagtatattaattgaaatcaagatgtaaaaatcagcttcacagtcacagacacatctcaagtgctcagcagtcatatgtggttggtggctattgtaccggacagtgcagacctagaacacttccatcaccccagaaggttctactgggcaacaatggcctagactgtatgtttcctgacaacagagactgtggtcatatgcatgtttatatttctactgcctagcatggttgaagtacttctaaaaatcctaattatatgtttgttggcatagagggaaaaaaaggaaaaagagttggaaataaaactaagatcttacataagctgtgagaaacagaagctagaaataggtaattattgaaagggagagacagagaaatttgcattgaaactctgattgtcctttggaaaatgtaatcgtttctagttaaagaatagggaagtagaaaaagtaatgagtccattatattcatttcatctcccattctctttccaaccctccctatttttttatttttttattttttttattttattttatgagacagagtcttgctctgtcacccaggttggagtgcagtggcacgatctcagctcactgcaacctccacttcccaggttgaagcaattctcctgtctcagcctcctgagtagctgggaatacaggcgcctgccaccacacctggctaatttttatatttttagtagagatggggtttcactatattggtcaggcttgtcccaaactcctgaccttaggtgatctgcccacctcggcctcccagtgtgctgggattacagggatgagccactgcgcccggccaatgctccctatttttatgactgacatattttcttcttttggaggccagtgatgacttcccaaggctctctattccccacttgacacgtgtgtgcaggtgcacacacacatgccagcttttctatagtccttaatgctcccaaagcttctcacaagatcctttcacaagaaaaagatgaagcatggtgatttctccgtttcagcttctctttgttctgagagaaaatattttataagtctctatttataaatcaaagtgataatgtagtaaattatcccatttttaaagtttattttaggggacaaatgtgtttccagctcatgatcttttcatttgggctttcattaagttgtaataagtatgtaattatggaagttgaattaagcatttctagtcacaaaacatcaacagccccccaaaaaagatcaactcaatttaaccgaaattggaaaatcaatgaaaatgaataaagagtgtcactcttctgtgagggtttccagagttcattgctgatccaggcaacatcagtgcaatccaaaggaaagaaatgtccctaaatttaggcaagctttggctagttccttgtgctgtgataagcttcacttcagcatgtttgctgaggaggtggaacgtgattccaagttcttgtctttgagggtaaaaaacttgcacatcagatgtccagtggagttccccagagtttgcaatgttttcctcccattgagacttggcactttttgtaggattcacatggatgcgatactttcttcagcaggtttgtgagattttattattaatattatttctgaagaccttctgagaaggcctgtcttaggtgtggttttaaagtctacttctcagccagatgggcagaaaaaacatttaatacagacttttgcagcattcatttaagaaagtatcccatttgggaccctgtggactttgagatgattcaagttgattttaaggtttgttaccttgtctcctgtcttcattcgcagtatctcaaattgcgtgttggaacaatgaatatagtgattccagttctgtcacaaactccttcaagagcaggagctgcagaaaccacacacacacacacacacacacacacacacacacacacagctcaccagcacctctggctctcacctgaatgagggacaaagcaaacgtgtgtttcctggcttgttgggagtggatactctggaatcccattgggtgacacgagctaagttgacacaataacaatttttcatctttattttccatttagtcaatttcctttcttaagtgcatctaccaaggaggaccccagcaggaagtgtttaaccaagggagaggcagatgatgcaagatgagtggggaggtggcaggcactgggaattttctgtgaatctgcctacctaatcatcttccctgccttttatagattcactttgtaacaaggcttgtaactgaggatagtcacacagggcagtgtagaaatgatccttactatgttgtcactttggttgttatcctttcttcttcccaccctcctcccttcccaggatgtctcacatggagccatctgaggcaggtgcactcatctaatctgctcctctcctgctccaaggattggcagccactattcttgaaagagtctatggcctatctgcttgcactcaccatagtcaatgctcaaacatgcaatttgtgggatgatgtttggcttgcccatgacctattgccagtacctagcacatgagagatgctcaaagaaatatctgttgagagttgaaaggcgggaaggaagtgaggaagacagcgtgattcacactggcttgaaagcaggtgaactggccatttcttccccttccatatcttaagctccgcattaatagatatcaagtttccccaagacatgtgcgttttccattacacgctcatccatttacttgttcggaaaaccctaccagaatatacgcttctggaagaaagggaccttggatttctgttctctctctctattcccattgccaaatatagcaccagataaataataggcactggataaagatctgttaggttatcagggtggatgagtggatgacctgtgttccttaagtttgtattatctcagaacattctgcaggatccacattctggcatggatatataaacagaggaagttactttattataggtgaaagcttagtcttacccttgtgcaatcatctggtaatctaatttattcactttatgtttaccttctgcaggaactgctttaagaaatagtgtcttggtccactgggtgaataggatggacaggagtatctgtgcctcttgcttaagtgtttggggagatgtttgcggaaaataagagccatatattccagtaaatgaaattaggttcatttggggcacttttttattattttctatagccatacttagccccccatttctggcatctctgtctatgtttttaaactatgtctggctgcactacaaaataaaatcagataaaggtctctaacgtttgataaatgttttatttagttgatcatcttggctgctagactgaaattcatctgctggaatctgccagctttctgaacacagccacaatttgcaactactcagagtaactaatggtcagggttttttttttttttcttttttaatggaaatagtttccaaaatagactcataaaaaagcaatcttaacatttgcattgagaaagtatcattagtctttttaaggggtttgagctgagcacttttctgtctttgtttgaatttgcctttaccttattatctattatcttccagataatctagggaaagtgatagcctgcccgtgaaaatgtacatataatacaagatattagggctgtgaatgtaatttgttttgtattttcagctggtaacgcactttctgaaactttataatgcccaaatttttaggccagatgtaaaaatggagagaatttctttctttctttccatggtaagtgttacataaggacttagtcttagatttatgtgcatttacttgctatgagatattcaagagtccttgaatatgtcagagaagaaaactgaagaatgttagggagaacatcctatgccatctagccaacgaatttggatgtgtagctgcaagcccaaagagaactatgtatttggtcaaaatgacccatgttaaaatattgtcacgtagcatgcatctccagaaacatactaaagacatctgtgaaaatgatgatatcaaatcaagctgccagaaaagaacaatggtaaaaaaggatagcatttcctccagtgccttcaatgaaagatagaggtagtagtcatactcttaggaaaataaatgtttttaggcctttctgatttaatgctaatacttttctcattatcatcatgtttaaaacattggcagtaattacacacaattcaatcatgctgtcaggaatattatcttgctttgttttggtgggtgggaccagaatgattcagatagtagcatcctcacaatttcttcgagctatttactcataaatatttctgttggggtaattttccccattttttttatcacttgctgctgtgaaaattgagatggaaaaagtagatgtaaataaattgccttattatttttaaaataatgcattatcctttcaaatgaaacacagctaaccaccctatgctaattgcacttgctccgttgtttcagcaaataaagtagaataggacattcaaaaggcagaatgctaagtcctggggtctgaaatttagttccatgagtgcaggcctcctgctgatggcaatggggattggtgggagggttagagatggggaaggccagggtctttatcttgtggcctcatttgctcctccactctggataaattctagaagaagaccttgatgagtctcaggactccactggtaaccgtaaccacttcccccatccctcttagtgtgacctatcaatccattaaagctaagaccgtggctagtctcttagtatgaccgcaatttagttgaaacctggcttcagagaaatgggccaagggcatagactacctgtgttttttgttgttgttgttgttgtttttggttttttgtttgtttgtcagttgtgagacctctctaaacctcgatttcttcatctgccacagtgagaataatcacaatcccaatctcattggcttattgaaaaaattcaaataagatgtgccaagtactagcgtgatacttatctataagcactctgtaaatattagttggtattagatgtttccatgattgacaatgagactgaagaagcagaaagaagttggagtttctcctacaggacgtacatttacactttgcccacacggcagagactatggcaagtttctttaaattgaatgaaagacagagctaatccagcctacaaaattcagcaataaaagctagtaaataagtattgagcaccacaaatgtctgctgaactcatggtgctggatatcaggacgcaaagattgagctgcctgcattggaggtaaagcagatatgtcgacagcacacgcatgcaaagatgtgctgttcaaaccgaaccttgatggctgtgtggaaacctggagtgcggaagcagaaggaagggcatcgtggggaaaggagtggcatggacaaaggcatggcatattcacatgctacttaaagactccagagatgaggctgtggtatagagagataccagaaaagggcagggagtttgaacaagattgcaaaaggcttctaatgtcattcaaacgattatagctatatcctactgtaaatgggaaaccaccattatttaaacattaaacacagctctgttcaacacagcattcacagagctgtgacttggacagaaaatgagttaagctaaaggagagatcgtcagtggcaaagttcaggcgttttggagacaggttgagactgacaagttggttctcgacatttctagcctgatggagataagagctgaggagctaccacttgaatctaaattctgagcttgttaaatagattaataaacctcagtccgtaggtattttctttcttctgttcttgggcttcttaaagtatcagacaatcagtagttactgggcacatgttgaatcaagagacacttaactttatcatgaagaaagattcatctttttagatttaacaaatgtttaattctctaagatatttcttttctttttggtattttatatggtaaagataatttgcagagtgatgatgaatttagagtacttctcttttttgtcattttaaatttcttcattttattttatatgaagtaccctaaaaagctaaagaatgttttcatttttggaaaaagttcttttcgagagctgtttatttttctttatcagccaaaaagtatgattactatgttaatgcaggttttgcttcatcaagagattttccagttattgaacttaaataacattgttctaaaccccaaatcctctaaattcctgttgtcagtgaaagaggtaccttctaatttggaaagaatatctagttcagttctgatttcaaaccagcagagaaaaataagaaaaatgttgctcctgccatatggagaatgaccatcatttaaggaaagaaaagttggttgagagtttttgggaagtaactgttttgtacttcctttaatgtactcagtgtccagagcaggaactgggtggttagaacagctgcaatatgattccactggaaagcagtttgcagagaggcaatcaaaagctgcaacacttagattaaggcaaactaatgatagaccatttcaagacatgatgacatctcaaaatgcctgggatccacatttctttcacttttgttttaagaggtatctcatttgctgtgccttttcataggataaaagcttgttgatcgtattatttagttgaacactttggggttctaaaagccgtgatcaaccttattggacatatggcactatgatgtcacattcaacaatgaaaggcacttcaagttataggatcatctattgcattggaggtcaggaaactttttttttaaagggccaaatagtaaatcgtatagactttcttggccaacaggcaaacttgaagatattattatcaacagaaagagtcaaactctataaaatttgaagagatttattacttcattctgaaccaaatatgagtgaccatggccactgactcagccctcaggagaccctgagaacatatgcccaaggtggtcgggccacaaataagttttatacattttagggggacataagccattaatcaatacttgtaaaatgtacaatggttcggtctggaaaggcaggacaactggaggagggtgtgtttccaggttataggtggattcaaatattttgtttggcaattggttgaaagagtttaaagacctggaatcaatagaaaggaaatgtctagcttaagataaggggttgtggagactgaggttcttactatgtagacgaagcctccaggtagcaggcttcagagagactagatggtaaatgtttcttgtcagactttaaaaggtatcagactcttagttaattctctcttggatcaagaaaaaggcatgagaaggggaaaagggattttctacaaaatatagtttttttcccccataagagacagctttgcaggactatttcaagatagggcaaagaaacatatttggggttaaaatatttttatttccttccttatctgtcatgtgatgttattgccagagtcaggctggaaagtaagccacattatgtagggttaaatgaaagccctcttttgagactttttggcttgtagagcatgattccccagatgtcttagataggaatttgggcaagtgaagaaaaaaggtcagagtttagtcctcattatgcaggtacttatataaccattaacagacaaacagagagccaaatcatgagtgaactcccattcacaattgcttcaaagagaataaaatgcctaggaatccaactgacaagggatgtgaaggacctcttcaaggagaactacaaaccactgctcaaggaaataaaagaggatacaaacaaatggaagaacattccatgctcatgggtaggaagaatcaatatcgtgaaaatggccatactgcccaaggtaatttacagattcagtgccatccccatcaagctaccaatgactttcttcacagaattggaaaaaactactttaaagtaagtatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcatatctacaactatctgatctttgacaaacctgagaaaaacaagcaatggggaaaggattccctgtttaataaatggtgctgggaaaactggctagccatatgtagaaagctgaaactggatcccttccttacaccttatacaaaaatcaattcaagatggattaaagacttaaacgttagacctaaaaaccataaaaaccctagaagaaaacctaggctttaccattcaggacataggcatgggcaaggacttcatgtctaaaacaccaaaagcaatggcaacaaaagacaaaattgacaaatgggatctaattaaacgaaagagcttctgcacagcaaaagaaactaccatcagagtgaacaggcgacctacaaaatggggaaaattttcgcaacatactcatctgacaaagggctaatatccagaatctacaatgaactcaaacaaatttacaagaaaaaaacaaacaaccccatcaaaaagtgggcgaaggacatgaacagacacttctcaaaagaagacgtttatgcagccaaaaaacacatgaaaaaatgctcatcatcactggccatcagagaaatgcaaatcaaaaccacaatgagataccatctcacaccagttagaatggcgatcattcaaatgtcaggaaacaacaggtgctggagaggatgtggagaaataggaacgcttttacactgttggtgggactgtaaagtagttcaaccattgtggaagtcagtgtggcgtttcctcagggatctagaactggaagtaccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaaggatgagttcatgtcgtttgtagggacatggatgaaattggaagtcatcattctcagtaaactatcacaagaacaaaaaaccaaacaccgcatattctcactcataggtgggaactgaacagtgaaatcacatggacacaggaaggggaatatcacactctggggactgttgtggggtggggggagggggaagggatagcattgggagaaatacataatgctagatgacgagttggtgggtgcagcgcaccagcatggcacatgtatacatatgtaactaacctgcacaatgtgcacatgtaccctaaaactttaataaaaaaaaaagtgaccattaaaaattataaaaagcattttaaagctcatgcgtcatcaaaacatagacagcaggctggatttgaccaacgggccatagttggccagcactggtctattagatcattggccacaatgctcagataggagcagttttatgtactgactgcagcatgttatcatatgtctatatctgaagtccactctcaaaatattaactcacacttattaatcatcaccttgaagtttgattatagggacagaaactaatcatgggtgatgggtctgatttcacattttgacagcatagttcatttctcccaccattaagaaacaggcaacctcagacagacacttggtaattaaatctagctcaaaatttggttacagtaatttttaaaaagcagtccaacagaaaaagagtaaacgaaaaagtgccatctagacattgactaaatattggagggaaccatcttggaatggctactttcattatgttagagccctgataggtgagaggagagggggcaaggggagacggagatgggaacagaagatttcccagatgaggggcactccctggagctgagtcttggagccagatggacttgttcacaccagcatggagtgaaataaggagaatcagaggacctgggctcataccctgtctctagaggctccaaaggagtccctgaggtaaaactgagattattctagagccacctggaaacaaaaagacactctggaccaggcttgggacattttcctgaaggtttcttccacctctcattgccctttctgtcattcctgaatttgagaatggggctgtgataacaaagaaactgaaagaacagtgtcaccatgtgtcttacatatcaccatgtgtcagtccctagaaaacgtactttatatggcatttgactttgataggaatctaatgaggtcagtaaagtgccctggttacagagatagagacctcaatgtcactaagatttaaacccctatcagcccatctccaaagcccatgcattttttctcccactatacaaatcaatattattgatatttatatgtgtggtaagcttgcagaataaatagattttgaactttctttttaacacagaaaagcaaaatacagtgaagttttggtggaactttcattctcatcaggccataggcttcagtgccgcattatcatatgggccaggtgggctttttccaggttactgagcccagtggcttctatagctcggttttaggaggctatggagaacagactctctcctgcccttggggggaaatgcaaatcaatacaggtcatttgttgagtattttgtcaataagaatcaaatggctttttaaagtacccctagtgttttttgatgcagaagtttcttgtgatcaaatacgtgtgcaaagatccagcaacaagggtttttgttggatctttgtttaaagcaccaaatgaaatggccaaccagtgggggtttgttcagtaaattatggtatattcctacactggtattctattaaatcatgtaaaatgatgtggcaaaatgtttaataatatagaaagatgttcaccatgtatcagcaggtggtttgcaaaatactccttaagctgtgatacttctttgtttatacacgtagagcatcttggtccaaggtacaaaaggatttgtgtgatgttttaggagtggtcctgttgggactatggttgattttaacttttccacagtgcagtgtctgagatgaccgtcttcagatctgggttgcttgagtctgaactttaacttcacctttcaccagccttgtgctagagaaacatcattagcttgaacaaccagtaaccataattatgatttgcatgtcataaaacattcttctctcatatcattgttaatgctccctgagaattcccttatcataatatggagaacaaatcccttttggttaaaactatgccttggtttcttcaactgtaaatcacagtaatgcctctctcaaagggctgtcatgaagagcaaatgaattaatacagcacatgcttaggagggtaatagctgagcatgagctattgctgttatctgtattttctagtttgggtgcagtggccacatgttatttttgtaatttagaaaaccaattctgttaatctttttttttgagacgaagtctcgctattattgctcaagctgtagtgcaatggcacgatctcagctcactgcaatctccacctcccgggttcaagcaattcttctgcttcagcctcccaagtagctgggattacaggcgcctgccaccacgcgcagctaatttttgtatttttagtagagatggggtttcaccatgttggccaggctggtcttgaactcatgacttcaggcgatccgcccacctcggcctcccaaagccctgggattacaggtgtgagccactgcacccggcccaattctgttaatcattttaaaaagcagttgtatcagtggtcgtaaggcaagagaaaggttaggatataacaccatgatgggtcaagcaacactatcacatttgaattcagacactagtttctttcttctccttcttcttcttcttcttcttcttcttcttcttcttcttcttcttcttcttcttcttcttctccttctccttctccttctccttctcctcctcctcctcctcctcctcctcctcctcctccttcttccttcttccttcttctttcttcttcttcttcttcctcttctcctccccctcctcttctcctccccctcctcctccccctccttctccccctcctccgcctcctcctccccctccttctccccttcctccctcctcctccccctccccctcctcctccctcctcctccccctcctcctccctctccctcctcctccctctccctcctcctccctcctcctctttttttttttgagatggcgtctcactctgtcacccaggctggagtgcaatggcacgatcttggcttaccacaacctcagactcctggattcaagcaattctcgcacctcagcctcctgagtagctgggattacaggaaaggcacccaccatcttgcccggctaatttttgttttatttttgtggagacggggtttcaccatgttggccaggctggtctcaaactcctgacctcaggcgatccacccgcctcggcctcccaaagtattgggattgcaggcataagccaccacaaccggcctagagactggtttctatatgagccagtttatttgttgaccaaacagagggagttgtgccaggaatcatggcctccgttaatgtttttaagattgcaggggaagcattccaaatgttttcaaaggtgtattaaggtaagtcttgtcaaaacattcccacttgaaataataagcattcttatttctttaagtaacagagacatagcaatggctttcctggctaaacgtgatcatcacagacacactgaccagctgtttatctttgcttccacaaattccaacaggcaacttaatagacattttgtggttatatgtttctaagacagccatgggaaatgaatttatttctacctttgtgaagaacagctatagaaatgaccattgaaattcagtgaatggcatttctgcttatgggccttaaaactgggaaccaaaattaaattcttttaggtattttctctcccgtgtcttctaaattgttgtgtgggctgatttttctccatgaaagactctcagagtcctaaattcaggttttctgtctccttgggctctagcattctggaataagcaagagtcaagagattctccattcttatttcctctgcatgttagaatatctaataggtgtgagacagtttatgttgtgctcagcattggacagccaccatgtaaacaattacggcgttttttcatccaggcattacattaggtccataacactcacaggagctctgtaaggctgaaattgccacatccattctactaggagggttatggagttcccaagggctgacctgcctttcctgagtcacccactggagagccagggcattggatttgacctcatagccgctgctctatccactcccttgggctattaaagaaaagcacgggacatattgatggaaaaaatctgacagatgtctcaaggacaactttatcttttatcagactcatttcagggatttctgtattcattgctcctggacttttcacatatttggggagcttgattgagtttccctcagctcttccattagaaagcccatgtggtacagtggctcagagcttgggcttaggaattcacaaatgtgaatctgtgaatctgagctctgcatcttattacttgtgtggccttgggcaagtcacctcacctacctgagcctaggtttctttggctgtaaaatggaactcatagcacggcctgtgtggaagacagaataatggctcctccccttcaaagaagtcctcatcctaattcccagaacttgtaaatatgttaccttacagggcaaatgggactttgtagaagtgattaagtcaaatatattgagattggaagattattctgaattatccagatgggcctgatataatcacagggtcttaataagggggaggtgggaatggctgggttggagatttaaagatgctctagtgctggctttgaagatggagcaagggcccaccatgcaagggctgtggacagagcttctggcatctaaaacaaaaaaggaaaaaaaaaggcaaggagagaaattcagaaggattgcagctctgcccacaccttgattttagcccactgagacccactttggactcctgtcctgaagtgtaagagaataaagtcacatggttaagtcactaaggacatggcagtttgttacagcagcaataggaaatggatgtaaccttttttatatggtttgtgggcttgaaagagatgacgtgttaaatacagtagcttttgaccttgaaagagacgatgtgtgaaatacattagttttgggggcttgaaagagatgacaggtgaagtacattaactcttgggcatgaaatacattagcttcatggccgttagcattggccatgaagagctcttgaccaatagtagctggtgttaccaataataaaataatggtgagacttgagatgacacaggagtgttctaacagaggcacagtccacttgaccagatctttctcaggcatctccatcgacagtggggtctccctagaaggctgggtggctgccatcccacccaaccagcctgcctgagttggtaaaagtgcatgaaagtgttcctctcagggggtggccttccattggccctcacaagggcacagcggagctcgttggttatgcttcagttacataaatccagccttacaaaggctacacagagagaggggctccttgcctcctagatctgtaccttgtaggtgctcaatacacattggtaagaatgttcacatcatcaggtaagcaaggggtataaagtgaggccttgaatcgctcacgtagattcaagtagtgttgagaaactaagaagtggtgaattgtacccttttttcccctcccaaattagaactcctaagaaatacaggacaactggagaccaaaccgtaggtttcattacctatgaagctgattaggaaagccttgagtttgtacccaaataaatttgctaatacttttacctaaattagagagattcggatggggtgggataacaacacgccacatctacctgggtggagcccatctcaggatgcctctgcccaggaggaggggcagtgagaaggaggccggaaggggaagagaaacaggagagggaaaggaggaaaggagacatagctagggagatgccactcagcaatcagaaacctccattccttttcctggggtggagtggaggaaaagggaaggggcagggaggctcctagcccacaagccacttttgtgcaataggaaaagatgcttgaccagtgacgatgagcttttttccaaatgttttttggccacagaagtgtcttgagaagtttctgttcatatccttcgcctgctttttaatggggttgtttgttttttttcttgtaaatttgtttaagttccttgtaaattctagatataagacctttgccagatgggtagattgcaaaaattttctcccattctataggttgcctgttcattctgatgatagtttcttttgctgtgcagaagctctttagtttaattagatccccatagtcaattttggcttttgttgcaattgcttttggtgttttagttggggggtggggggcaagggaagggacagcattaggacagatgcccaatgcatgtggggcttaaaacctaaaatatgggttgatgggtgcagcaaaccaccatggcacatgtatacctatgtaacaaacctgcacagtctgcatatgtatcccagaagttaaggtaaaatttaaaaaaaggaaataaaagatgcccgttcctctgaatggacatagcccatgccaagggtaaggcttggtgagtggaacaggctggattttaatcctcaggttgctgcacccttggtgaagcacagggcactagagaagagtgttcacaacctccagcccctccacaaagaagcctgattctggaaagacagaggttccaacctcacccttacttctcttctgaagatctgctgtgcatgaagcattttggaggtatttcttcagctcagaacacagcaactttcctatgaaagagagcacaaagggttaatgccaccagaagacactcagcctgtccagtgtcgctaccactgggacgggcaatgggaggcatctgaggctttgctgacaacttcttctgctgtgagggtggaaagcaggccagatctttatgacctggactccacgttttgggattctagcaagatgggacccactccgggtgctgtgcccattctcagtgccagtggggctgatatggggtcatggcaggtagcgggagataacagcctcatcctcaacactagacatccagacagagtggctcaggccctgtaagcaactggtgttagggcagataatgagattttctggtgtctgcttggtgacaagagtagtggcttcaaggaatttttttaaaaaataacatttgtttatagttgtgttttttaaagtagaaaatatattcatacgagcaagtaattagtgtcctgccaggtaagtctcatggtgacatgtcaacgtaattattttttaaagtctgcctcaaataaagcatcaaaatttcctgctttaaatctcctttctctgtaaaaatggttaagaggagtgaaaagagaggatgggaggggtctgagagcattgatgcctcatcatagtcagccagctgtggcaccacctctgtctttgcctgtcactctcatacaaaggatgtgcataggaaatgtgatcctacccatcctcaaattctagatttggacttgaatttggtgctcttatttccacattaagttaaaatctagcctccagatccccaggcttcccctcccattgtacccagaagaaacaagaattgtttctcagttctaactgtcataatgcctagcgggcgttagcctacaacgaaggataattcaatctatcctcaccttagtgtacgctggacaacactaggactcagaagtgctttgctcttgatcttgaaaggccagtggaaatccatgcagattcctcccccaggaccctcccagccagcctgataatgaattcatgggaaacagcctacatgtgagcaccaaagggaacacatttagtaaactctgccaaaggagcacagttcttgtaaagctgatgaggtttgtgattaatccttttttttttttttttttttttttttttgagaaggagtttttgctcttgttgcccaggctggagtgcaatggtggaatctcggctcgccacaatctccacctcccaggttcaagcgattctcctgcctcagcctccggagtagctgggattacaggcatgcgcctccacgcccggctaattttttatttttagtagagacggtgtttctccatgttggttaggctggtcttgaactcctgacctcaggtgatccacctgccttggcctcccaaaatgcctaacccagtttaaagagatccaggaagcagattgtgagctgcagatatgatgtgattattaaaagcagcctccattgccaacattgcaaacgcatcagcatgttccttccttcaacattccataacgtggtggtggtattcccaccttaccccgggagaagctgagagtcacagggagtatttactttccaagttcacacattcagggaatgggtagaagtggaattcacacccaggtcagtgtaagaccaaagaggctgtcagaatggtttgctgttccactcatggcaaacaggatttgaagttgttccagtccaagggagaccatcaggccatgcaggaataaaaaggccaaggggaggaaagaagatgctgtcttcattaaggcctgaaggaaaaggctggtcagagtgaagagtatagacaagctcctctgtatcctctcaaagatttggagccactgatctctctgggggttggggaatggggcagttcctgggaaagggacttattggtgggaatccagttctgctatgaatgctcctgactcctgcactcaaatcccaacagatgaaagggaggagagactgacagatgcagtgccttcctttatgtaacctccttgatccaaactacagtctgacccatgctttctggctttatattgtaccactacgttcctaactcaccctcgttccaatggcatcagcattttctcttccctcaaagataatgcacttctgacttttgcatattatggtagccagcccccaggagggctcccagtgattctcacctcatggtacccatgctcctgcgtggtcccctcccacatcgaataggaatgacttgtgtagccaaataggacatggcagaaatgactttgtgtgaattctgagccttgtttattcttgtcctttcttgctacaggcaaagccaaatgccgtgttgtagggaagctcaagtagcttcatggagaaatccacatggcaaggaactgaggccacctactaatagccagcatcaattctttagccgtatgtgtgagccaccttggaagtagaccttctagcccccatcaagcttttagataactgtagcctcaccaacatcctgactgaactacacagctgagcagcttccatatctccaagccacaaacactgtgtgcaatcataaatgtttttagttgctttaaagcactaagtttggggtaattttattcagcattagataactaatacacatagtctgtttcaccagctaaaattgctgctcatttctctgttaccccccaaacctggtgtgagcagcccctcctctgtggactttttctggtcttctttgcatgactcaatccctctttcttcattttctcacacagattgtttagcattctattaatgccactgtcacaaggaaaagcaatatttttattacagtctctctcctctgtcgattctaggcttcttgagaaagtttgtaatgtatgcattcttcaaagaggtattgttattaatagaggctcagaagatggctgaatgaatgaagagtgtgtgttagaacctggggaaatttaaaccaaatacatttaaagccagtgacattttcaaagcatatttggctagaaagactaagttctttaaagtagtttagaagcagtattaatggtacacagtctttgtcccattcttaacagtacaataatgataattggttgctactctggaaacaaattaaagagcccaggaaacgtttccaaaggtgactggaatgcttaactgagctagactgttaatatctaatgctagccttcctgtgggcatagcaccctgaattgcctgatctcatctaatggcacatgctcagacatccttggttttaaataaaaattgtcttatcacttagtttaaaaatgttttgcttagtaaaaaatttatgagggcaggtgcggtggctcatgcttgtaatcccagcactctggaaggccgaggcaggcagatcatgggctcaggagttcgatgccagcctggccaacatagtaaaacccgtctctactaaagatacaaaaattagcagtccgtggtggcgggcgcctgtaattccagctactcaggaggctgaagcaggagagtcgcttgaaaccgggaggcagagggtgcagtgagccgagatcgcgccactgcactccagcttgggcaacaagagcaacattcggtcgaaagaaagaaagagagaaagagaagaaggaaggaaggaaggaaggaaggaaggaaggaaggaaggaaagaaggaaggaaaaggaaggaagggaggaaggaaagggaaggggaggggaggggaggcgaggggaggggaggagaggggaggaaagggaagggaagggaatacatttaataaatgtggagtctgccaaatcaggtcggcagtttacttctcctgtccccggttcaataactcacttactggggttctggaggatagcagtgagaagatggggtaaaaaattagagagaagttttgcgttgccccatggctgcttctgtagtgtagtccgtgcatccgcccttcgatgcttgggttggatcatagagcagtgactgttgatggctcacccagatccccaggaacccaccactcccatacaggctttcaacctgttaatccctgcagctgcctgcctggactttcctctgaccatgggagtgtgctcagtcttactgcccagggaacagccatcagcctttgagtggcaagagttggtagattaccatcccttcttgacccttggaataggacaacttcgagatatgttctcccgagtctcccagatgaccccagtgagtttgaacaccagttgtccacagagataatctgcccattgccacctgtgtattgactcttttacatattctgtctcacttctctttctccctcacttgtgcttcttaagattgtatcctgaataagctatttgcactcaaataggcagagagctagctggatccattattctctcttgtcttctatattttagatatcttgtaacaggcacaaggtaccgtgtagagctgaggtgtaatgacccagctgatctgtttgtactttctcatgctgctaatgggtacctggagttgagaatttatgcataggtgtgtacatgccatcacagctctgtgtgcatgagtgcctgtggggtctgcatagcatgcacacatcacagaaaccctctgccctcccttctcattcctctatttgaagccaagtttccataatccctctactcaacccccttcttccccagcccccaggggcttcccatacttagggtcaccctttcttacctcagagtttcaaagatgtaagagctgatgcccaccttgatggtattcacaaagtatagcagggaggcggccatggaaatgactctttacagcaggatgatatgtggaacatgccatggccagggaagtaactttgtctcaaggggatcaggaagatgcccaggtatgggataacttgagcaaaagatttttgagcactgatctgcagattttactctctgtaaagggccagatagtaagtattttaggctttgtgggccatatggtggctgctgcaactgtgcagctttacttttttgtagcacaaaagcaagcatagataccacataaatgaatgagcatggctgtgttccaataaaactttatttacaaaagcagatggtgggccagatttgtcccattagctgtggtttgctgacctctgatttaaagagtgggaagtagatttctggaaagggagaaaggaagactatttctagcagagagaagaaaacatataaaggcaaagagtgggaaaccagagggaataagacaaatttgatttaccaaaaagtcctttttggtggtagtaaaaaatactaataataaaaactaagttttattaaagccttattatgagtcaagcattgggctaaatattttgtggattctcatttaattattactctctctgagtttggaggaccttgttttcctcatggcacacacgaggagtaaattaagctcagagagggtagatgactggctcaaggtcacacagctaccagctggccaggtggcaagaccccggacagaggattgggagcatggtattgtagccagcgtacctccttgtgtctatcattagccctgctttaatggactttttcagaagtgtttttgcttgtgttttacaagtggaatgtgattccttgactcagcccagtagccctgtgaatggatggctgaaacgagtctgacggctttttctcctggggccattttgtaagaaataaaagcaaaacagtgagatatttaaattcttcagggatattattttcgagtggataaagtgaagaacattttttattcatattagaagtgatagttggatgtgtgtaatttttttgctctccgagatggagagagaacacagcacagatcttagaatgtaaaatatgaatttagatgacattttgagaaaactgataaacaccaccattccacaattggacttaacttgcctgtgaaaatccttctgcagcccacaaaatgatagagataggtggactacgtctaatggatattaaaaatacacaacacaccaatgaaggaataattttcttttgcaaagttttcatttctcaaaatgctaccaggaaaagagagataccttgacagctgacagtaaccctgggaataaggatatgttagaagagaagggctgcagtagttgtgaaatcctacctggaatctacccctggacaggagacccagggatcaagactcaaagctgatgctctcaacaccaatgtttcatctccagtgtaccacgaggtccttgtccacctacttctagatagagccaaactgtctaagccaaagggggtttgggtttctttcaccacccacctgtgcacatgattagtttgaaaaagtatgtcttaaagaaaaataaatgcagacaactaagtgagaacagttacatgtactaaaggtctttcagaaaatcagtaatgtaggtcagtgcatttcaggatttggaatttcacacaaaatttacccttgaaaactttagactgagagaagactaccatgcctattctgtcatgtaaggacatctaaagaagaactgcacacattggtattaccatcttcccacacacatacacggacacgcacgcatgcacacgtgtgtgcacacacagacacgcacacacatgcacgcatgcacacacacatgcacacatgcacgcatgcacacacatgcacatgtgcacacatgcacgcacatgcacacacgctcacacacacagaatggttcgtggccgggtgcggtggctcacacctgtgatcccaacactttgggaggcctacaagggcagatcaactgaaatcaggagttttagaccagcctggccaacatgacaaaaccacatctctactaaaaatacaaaatttagccaggtgtagtggcaggtgcctgtaaccccatctactcgggaggctgaagcaggaagattgcttgaaccagggaggccaaggttgcagtgagctgagatcacgccactgcacagcagcctgggggacagagtgagattccatctcaaaaaaaaaaaaaagtttcatactttcactcacatatacactcacacactcgcacatacacctacacatacactcatacattcccatagaaacaagtgagttataatctcagagtgaacaaaattgagtaaattttaccatacaaacatatttattatgcttgtctcactaaaaagcagtaaaaattctgatatgagcatcacacaggttaatgtaagatagtaagaagaagaaaaaagtataattatcctagaagtcctattgaagaatgaaatcgcaaaataaaaatggaaggggcaaaggtaggatccttagaatgcttacaatgggaatctgaatgtttaatgagaaataagcccgacacccatagcacataaggactcaggctttgggatctctcccttcctagctttgaggcctgggcatgttatttaacctctcataccctcgaaaggggctcataaaagcaatcactgcatggggcttttgcttggtgaatagttccagcacatggttagtcctcagtaagtgttagctaatagcattagaaactagcttttttaaaaaataaaggaaggggccaggcgcggtggctcacgcctgtaattccagcactttgggaggccgaggcgggcggatcacgaggtctggaggtggagaccatcctggctaacacggtgaaactccatctgtcctaaaaatacaaaaaattagccagacatggtggcgggtgcctgtagtcccagctactcgggagtttgaggcaggagaatggcgtgaacccgggaggcgaagcttgcagtgagcggagattgcaccactgcactctagcctggcggacagagtgaaactccgtctcaaaataaataaataaataaataaataaataaataaataaataaataaataaaataaaaataaaggaagggctgggcgtggtggctcatgcctgtaatcccagcactttgggaggccgaggtgggtggatcacgaggtcaggagtttgagaccagcctggccaatatgatgaaaccgatctctactaaaaatacaaaaattagccaggtgtggtggcatgcgcctgtagtcccagctgctcaggaggctgacacagaagaatcatttgaacccaggaggtggaggttgcagtgagctgagatcatgccactgcactccagccttggcaacagagtgagactccgtctcaataataataataataatataataataataatagtaataaagaaagtacatggggaaggaatatgttctacatgagctttcacaggggcaccgatctagaccagtgtggactagaagtagccacatcccctgagatcctgtcggtaaaacacattctcgggcctccccacaaacctcttgatttggaaccctgggaggtggcacccaataacctgtgttttcaacaaaccctctagatgatgccaagccacactaaaatttgagaacctctgatcaagccctgcaagctttttaaccctggtcctgggcagtcagctaaatccaggaagtatttcgcagattgggaataaataaaagaagaaaaaaaaaaaggcataagtgtctttgggttgaatctcattttaagccccagaattaggcttgtgaaaacaattcaagaattgtcttcgagcctataatgcctgctagtcccatgagaaaaagattttgaaacaaaataagttgaggttggatttgctttttttccaagcttcaaagcatcaaacaaagatccatgttcacatctgaatatctgagttcacatctgagtcagccgctgactcagcccctgaccacagagtgatgaacagagaggcaggcatcatgggacctgaaatggcattttctccaaaatattagaacgtccttagatcccttagatcaatggtgatcgtgggcctggaaaacttctccaaaaagtgcaaacttctcctgtagttagcatattagtttgttctcatgctgctataaagacttaccctagactgaataatttataaaggaaagaggtttaattgactcacacacagttctttgtggttgggaaggcctcaggagacttacaatcatggcagaagggaaagtcaaccgtccttcttcacagggtggcagcaaggagaagtgctgagcaatgcgcagggatagccccttataaaaccgtgagatctcttgaaaactcattcactatcatgagaacagcatgagggtaactgccaccgtgatccaattacctctcaccaggcccctccaacaacacatggggattatgggaactacaattcaagatgagatttgggtggggacacggccaaaccttaacagttgggttcaaagacaaatgccaccataataggccgcagatcacctttattgccagcctctctagtccccaagtagctgataaaaacatagacaaaaattatagagaatgaaggaaaaaaagtaaggggttattttgagagcaaagtttgcctcatctgtccaatagagactgtcttgtatgttaaaagttcatcatcaggagctgaaagaattgaaagtaaaatgaaactatcttgtgtgcctcgtaggaatacaacctggacgtagtgtccattactaattaaagccaatgtgtattgtactttcacagtgagacaggccctgctctttgttctctatatttatttacatgcacttaatcctcacaattactccatgcaataaatcccattatcactttctgtactaggttgactagggtcctccccaaattcatgtctacccagaacctcagaatgtgtcttttcagatgtaattagctaagatgaggttatgctggattagggtaggccctacgtccagtatgccttggagtatcctcataagaagaggagggccgggttcggtggctcatgcctgtaatcccagcactttgggatgccaaggcaggtggatcacctgagttcagaagtttgagaccagcctggccaacctggtgaaacccaatctccactaaaaatacaaaaaattagccgggcatggtggtgctcacctgcagtctaagctactcaggaggctgaggcatgggaattgcttgaacctgggaggtggaggttgcagtaagccaagatcataccactgcactccggcctgggcaacagagtgagactccatctcaaaattaaaaagagaagaagaggagagagacagagacacacagaagatccaggagagaaggccaagtaaagttggaggcagagagtgggatgatgagtctataaaccaagaaataccacgggtcaccagcaaacaactagaagctaggatagaggccgggaacagatgttccctcagaacttccagaaggaaggactcttgtagatgtcttcttttgtgcttttggcctccaggactattagagtaaatttctgttgttttgagcccctccggtttgtgacgtgtagttactgcagctcctggacactgagatgcccctgtttcttgatggcgaaatggagactgaaagatcatgtcttacccaggtgcacacagccagcttttggaggtttagggtcagaggcagcttcgggggtaggaatctagaatctggtttcctcatcttgtgctgtgtcgtaggtctgctgggttcaggttctggagacgtcattccatgtttctgagctctcttttctcccctgcagatgtaagaactctgtacttgaggactcatgcctcagctgggtggtgggattggattccttttaaggtctctccaaaccaaccctgagcctctttgattagaattctagaagctttgaaaccaccactacaaaattcatttgcacgacatttctcttttaagcattacacttctctctgcagtaactttgaagttactgtcgttttatgcactcacgaagagttaacaagcaataataaacagtcaagactgcttttcatttcacatatctgcatgtgttcagtcttttccgtgacacaattgaaggagcttctgtaatcaggagagaaactttatatcatgctgtaatttcccttgatacaagctagaaaaagatactggtttagattcactggggtgattgactagaaaattgccccagctgtcaaagtttccagtgttaaaaagcagtgtaaaatttctcaaatgcttagaatttctagatgtcacaacagagatgttaccaaaatatgagaatcaagttttttataagcaggacaaaaatacattatttttctcaagttctcaatatttggttgaattcatgaagaaatttttaaaacacaccaagcaaagcgttcattttgtttagaaataaaattaataagttgttttttgatattgtattaatgtgtcctgccacattaaaagattgcctatatatttataaatttaatctttatataggaattaaacagacaagccagaaaaagaaaagaaatgataagctgatatttgggtataatattatcttgttatccatgttctttgtattagctgaattatttccatttctgctccaaccaagaaaatcaattcaaacattgttcctcgtgatttattcaaaaattcgcttttccaagtttccgtctaagagcatgtggtgggttcttatcttcatcataaaagtgtataacataaagagatgtcctcagatagctcatggcatttgttagctcaggggggttgtagaaagtttcctgtaagcgttttacactcaaagttttctttatagtgccaaagaatgagaagcaaaagcaattcagcactggaaccgtttggggagtgtggctccattctgaggttctcttctcatcagagtgggggcaccctataattttgagaccttgagccaggctttcatgtcatctctctttatgaacactccactagtttctagcctataaaaatagtgtcaacattacagtaagctaagtataaggcagaatcaagaagccaaggatctgattttatttcagagttctgaaatggaactaagtgttacagaaagcaatttgtgggaaacaattctctacagtatgacttatagactgcttcaaaggagaggtgtcttctcttcctagacctgggattttaatgtgagagctcccttatcatgttgaggagaatggctgtctgaattgttctccctcttatttataaaggcaatgatcagaagataatttgtaagtacctactctcttccaggcacagtatttaaaatgaatatatagtaaaaaagccagctgcctcccctgtcatcatggaatttataacttagtagagaagatgtcaaaaagatattgcaaatgatctgagtgttttttacaatggcattgttgtgtacaacaggtggattcccaccttgttggggaaagcaaggagtgctccctggaggaagtggtatttattttgagacctggaaattgttagccaggaaaggagataaagtggcgggagtgagagcaaaaatattgtcaccagagaaatcagtgagtgtaagaaattgctggtgtagttaaaaactgaaaaaagtctggatacattgactgtcgtgttttcccagttgtaggtcttgtaattctggcaaagggaaatatgaagtgaattcctggaatctcttgctgatcccagagagactacagttctagcataaaaggaagctcaacagggtgactgtaagaggttccagagcagcaggtcatactcagcttagaagtgcttgcaagacagtttaaggatgtagactgtctaaaagaggctcataaagagattatcaatctaaaagcaaacttgaaatattaatcagggctagattaggttatgctgcagtaacaagttaacccccaaattttagtaggcatagcgcaacaaagtttctttcttgctcaagctgtgattccaacatgggtctgctggggagctctgttccacgtagtcattaagggatccaggctgacagaggctctgccagcttgcagcatgtggagcactggcctcctttgtgcctgtggcagaagaacaaagagttacagtatcaaaagcagcccttaaatgcttcaaccatccctttggctagaactagtcatgtggccccacctacctgaagggagggtgagaaatgtgagggaacacgtgggcaatcaccaggaagttcctttgtttgttgcagtgacagtctggaaaacaatgtgaactggttgacaagcttaaaaatggatctaagggcaaaaatgctaaaggagagaaagaattgttgacagtgtataagaagatgattaggaacaaagtgagatgggcagtttggaggctctttttttagctttaatggtaatagaatacacgtggcactctcactaaatgcaaggcattgggctttatgtagattgtcccatttaattttcacagcaactctgaggtcgatattattatcgttctcattttacagataagaaaactgagccctggggtgatgaagtgactaaccccagtgatattgtctggctctgtgtccccacccaaatctcaccttgaattgtagttgtcataatctccacatgtcataggagggacctggtgggaggtaattttatcatgggggtggttaacctcatgctgttctcatgataatgagtgagatatcatgagatgtgatggtcttttgttttgtttttttgagatggagtcttgttctctcacccaggctggagtgcagtggcgtgatcttggctcactgcagctctgcctcccaggttcatgccattctcctgcctcagcctcccaagtagctgggactacaggcacatgccaccacacgtggctaatttttttgtattttttagtagagacggggtttcatcgtgttagccaggatggtctcgatctcctgaccttgtgatccacccgcctcggcctcccaaagtgctgagattacaggtgtgagccaccgcgcccggccaagatgtgatgggtttttttttgttttttgttttttgtttttttttgagacggagtctggctctgtctcccaggctggagtgcagtggtgcaatgttggctcactgcaagctccgcctcccgggttcacggcattctcctgcctcagccttccgagtagctgggactacaggcacctgccactacacccggctaatttttgtatttttagtagagacagggtttcaccatgttagccaggatggtctcgatctcctgacctcgtgatctgcccgcctcagcctcccaaagtgctgggattacaggtttgagccaccgagcccggccgatgtgatggttttataaagggcttttccctgttttgctcagcacttcttgctgctgccatgtgaagaaggatgtgttggcttcccctttcaccatgattgtacgtttcctgaagcctctgcattcatgctgaactgtcaattaaacttcttttctttataaattacccagtctctggtatgtctttattagtagcttgagaacggactaatataccagactctacagtttgtaacgtaggcactaggattcacagatcctaggcacctggttctcagattcgctaaactttaccattgttctttgtccgtagcctggaagcttagaatctggaaggatagagaatagagttttatagggactgggacacactggaaatttgaggaattttagttaggttaggaggcagttcctacatataggtggaaggagaaataccaggagtcttgtcttgtctcagcctaacaagatgacttctgagaatatgatcaggcctgtttccgccctagcattggagtccagtgatatccaagggcctttatcaggaaaactgcaacatatgaacacaacacagcctctgttttggagtccccagaagacagctgattggtttaagtaatagtctagggacaaagaaagaactaatacttcaatgaaaaagaaacaaatacttcaatgaaaatgaatttcatatcgcacttctacattccttatttgagggtatttgagcaaactaacagaggaagaaaattagccactttaactataataccttgagtattagactaatccagttataagtttacagaccctttgatcagaagtcagagaagttgcctaggaaatgagttaaacctatttctaaaatgtccaaaattagctgttcaaagaaatcttttttatagagcctaaaatattctaggcaagagataatgaaggatgctctagggcaatggtgcggggagaggaaagaaaggtgcctcaatacaagcagcatggcaaaggtacaatcctcccagtgtgaatggtggggggaacaaggggaactgaaaaacatgcatgaggacgttagctttgaatgggtttcttagagctgggggacaaaggaagagtcgcagatgatcagaaaggagatgtgaaatcttctgcttgctatgttgagtttgaaaaataaatgaaaaaatttcaggtaaaaacagcaaatcatagcaaataaagatctcatattcaggaaaagggctaggcctgggtaacttcatgatataaatgttcaccattgctaaaacttaaaggactgacaatatcaagtgctgacaagtatgtagaacaactaggagtcttgcaatgtttttcaaaatggtagccccagtcttgaaacaatacatatgacttctaatgacagaataagtcaatgactagaggtaaacagtgatgaaaaagaatgaatatggttgacactcacaggctctaagtggagcaaaagaagccaagtgtacaaaaaagtacattttgtatgattccatcgtttatgaagttcaagaaaaaacaaaaaggatttatggtgatagagatcagaatagtgactaccttgcagagatggcagttaggagaggacataggaaagcctgctggagactgggaatgttctctcagtctgggtattagttacatggatatatacttaagtgggctgcagggtttgctctgagggagcaaacacagcttgggctgtgtttggccttgaatattgtgaataatatgtttaggcaaaaatcctctgtgtctcgacgtcattgcatggatccactctatggttggccttagagccaggttcttgtttgcatataattttgcggaagtgtttatgtttgccgctcaattgccaattttgattacagcttctcagcctggaaaattgtcctggaagggcttaatggaacacttgcaggaatgtggcatcatcaattttagagccagaacaggacgtggctagcttttcagctggccgggaagagcctggagagtgctgagggacaccagccagggacaggcacaggatccaccacatggctctggcctcagttctgcccagctcaaaatcttcatccaagttttatttaaaaatcctttgaagggagagcaatgggctgccccaccaagagaagtgttcacaggaagtgcctctcctcaggtttcaaccatcgcctcccaaacttcaattttttaaatttcacctttgtaatgtctgctatttctaacatctgttctaatatatacttcatgtgctttttaaagcaacatgctctcttttacttcagtaaacatatttaggtaagacataccccatcaccacagtgccacagtaaatggaaaaccagcactttgctaacacgttttaaatttaaattattgcatgtactgccttgcgtgttagctctcagtaattatttttcatcctcttaggtttcttccagctttaaggctttattattttaagttataaagtaatcggccaccctgtatgactgtgaggtccttcaagagagaaggtactctttgctctttgaaatttaggaaaaaaaaaaagaatggaaaaaccaataatggaaaaaaaattgtatttttatgctaatagagtagtagcggccaggtgacctttagcaggttccttaatagtgtgtcaccaccaacacagtgtaaacaccaatacggtgtcaacaacagcaataaaatgcagtttaaagacagcttatcccagggtatgctatgagaattggatgagaatattgttaaatcccttgtgagttttaaagggatgtaaaagtcttagaaatattgatgtgatcattggcaaatgcagatggatattagagaaatcaatctaaattgtatatgtagacaccagccacccccggaaaagaacatgagtgggtaattcttccacctatgggttttcccatgggatgcaacctgggtgcatggaaccagccctggcttcagagttagaggggcctggctagtgctggttctgccactgaccttgacctgagtgaccttgaaaaagaaatctaacctcttgcattttcaataacttcacctataatacagggcaaatcatcctactatatgaggtcgttgaagtttaaatgaaagagtgtagagtctgcccttgaaacacgttgttatttttcaagcgattttctgaagctagagcccctcatgtgagggatggagagatgaatccatcagctgttaaatgcctgcattcgggtgccaggccaccttccttcctaggtaaggtctgcaaatccagttctcccctgctgcgcagagtgcaggtccagctctctgcccaccgggtgctgtctgtttagaggagccagctctggcttgcgctttaatgtcatgtttaatgcctgctctgctgcagcctccacatgtttattgaatctttatggaaaggccataacagctgcttcgggtccattataatggatcacgtcaaaatgtagcctgccattgttttaaagtcatgtattattcacttgatggagtgtatacgtccatcttatgtcaatttgtgttatggactgtcaaaattaacatgagtatatgaggtaaggcatattggggaagaaagttccacagcgcaatatgcaaccgtggagtttctaatcttaataattcagtgggtgccaacaagacgtggtctctattacagacttgaagctggtaatacttcatttttaaaaatgtaaccatttttgagttacaggaaaacaaaaatggtctgtggccaataaatgtctagttttataccgttctataaatgaaagtaataaagcacagcaaagttgccgagcgcagtgggttcttaaacacctgcagcgtcatttctcatcagcaggtgggcggcagagttcacatccctgggccctgtcggggtctggccatctccaggtggtgacaggtggcatcagactggcctgaattcagccttggggctgtgcattctcctggggcttattacagaggctctgacctccacctataggttcaattcccctccaccccaaggacttaaagaatttttccagacactttatgactcaccacctagtggctcttcccagtgtgactccagctagccacaccaagtccctttcagactcatgaccttagcaggtgctgttccctctgcctagaactttcttcctttatgtcctcacctggctgaattatactcacccttcagttctgctgaaatgtcacttctccaaagaagcatttctggacccccggcctccctattccaccctcctctggtaccccttttataggtgcttcttcctcatgcacctgtccaggttgtatctaaattagtaataaaagtttgatgtcatcctctctacccacaaataatgagtgcaggatccatgtctatggcgtccaccctgtagctgtagcacttagcattgtgcctgtcatgtccataataggtgctcagctagcatttttgaataaataaatgagtgcatggatggaagaaagcaaggttgtctggcagactgtcttggttgaacatgatttcctattcatgatgacctagcccatgctcttcaatcctgatagcttttttagattttttaagcccaaggctctgtcttgtcatatgtaccctacccttttcattatccttgaagagaaactcacctcccaccctggaatccactggagcagcctgtaccctgccaaccagtgccccccacaccaggactctctgccacgtgtgtgtactcaccaagtgctcctccatttcccattcctgagttggatctactccagggtcactcccttgcttcatggtagacccttgatgtcagttccctggcagctggcttgggctcttcctagcgctcagattccacctcagtgggcatgtccggttgcacatcccagaagtatatatcttccccattctgtggcatggttgcaaggacaacattgaacattgggaaaaggaggcaagaacgacaacagtccccatttcaaacacttcagtccctcgttatgcagctcctagaagtatccattgttctgggaaagatgaagcatccagaacctgtgtcaggactctagaatgaagattcaccttctctgcaccagcccagatggagagcgtcctgggcaaccaaagtccccaggagtatttgcacctctcaaccaagattcttagatcacagctcttaatcacttaccctgcagtccacccacaggagatgagctttatttcagttgtgtaaattagtgaaacagaaccccgaagagctgaaatgtcctcatatctgtcacgaccttaccatgcactagatttgtttccacagataagcttgtgggtttgcacgacaaccaagagaatttgcagttaagagaataaataatgcattattagaagaataaatcagcatgcagtgtacatgagtaatatattcataccaggcccagtgaaggagtagacacttatttagtgtgtttatgcagacatagatttaaaaatgtataaccacattattatgggttctttacaattgtaggagcaggaagttcacacaggtcttccagcctgtctagcaggtggactgagagtcatgaatttcatgtctttttcttttttctttttttttttttttttttttttttgagatgaagtcttacactgttgcccaggctggactgcagtggcgcgctctcggcttactgcaagctccgcctcctgggttcacgccattctcctgcctcagcctcccaagtagctgggactacaggcacctgccaccacacccagctaattttttgtacttttagtagagatggggtttcaccatgttagccaggatggtctcgatctcctgacctggtgatccgcccgcctcggccttccaaagtgctgggattacaggtgtgagccacctcgcccggccaaattgcatgtcttaacaccccctcttactagctgagaggtcttggcaaacctgtagcactgagagtgtcaagtttatccatctttaaatggggccaccatctaacacagaaaagccacagggatcagagaagaaatcatatgagtgggttccgtgggctgtaaatcctgaatgcgcatgagatgggaaggtcagtagaccaatgattttctcatcatagattcttgctgtgtcaacttggacaaaaaacttaattttcggggacgctgattctttttctctgtaaggagaagttattggtctgatgcacacagtggaatcaaacggcaatttacttgtaatgaaaacctctctctcccggtgtccttatagcaaccccagggacagactccagttggctctatctgtgcctcatgtccatcctttgaaccaaccacgggccagtagaatgtagtactcggattgaccaggcacctgaagtctaagacagcttccatcagtttcctgataactggcatttactgagcactttgtctgcactagatcctgtgtgtcatgcacactgacttatttaaccttctggacaacaacgtaaaataagctttagtacaaagagaagttctataacttgcctgtggtcacatggttaaaaagtggtgaagctggaatttgtaaacaggtttcttggactcctaagcctaatttgtaaatgctatgttatactgacttggttgcagtattggtgggagagggcatcctaaacagcacctgcttgttgccaagcccttgtggatttaagctcagttccttccccagaccttgtcgtgtgaacctccattctgacttcacatccatagtaggcaagataatggccctcccaaaggtgtccatgctttagtgccccagaagctgggactatgttgcctacctgagggacattgcagatgtgattaaggagtccttgagtcggggagatgattctgagttatcttggtggatccactctaatccaatgagtccttaaaatgaaagaattttttctggctcagagaaaatgtgaagactgaagaagagaacgggacagattgcagcataaaaacaactttgtccagcactgctggctttgaagacagaggaggggccacaaaccaaggaacatgggcagtcccaagaagctggaaaaagtgaagaaatggagtttcccctggagcctctggaaaggagtgcagcccttccagtagctagatgttagcccagcatcctgtgttggacttctgatctgcagaactataaaatttacagatgtgttaagacaccgtgctgtcgtaatttgttacagtagcaatatgaaagggatgtaacattcaaggcagaaccaaaaacaccaggaaatgctgcagccaccaccttcgaaccagcttcaaaggtcagccagtcatcagagtcagaagttttgttttgtgggggcggtggtggttattgttttgttttgtttttttcctctttattctgaaaagtgccagctctcaagctggggcaaaaatagctttgtgttgtagcctcaatcaatagtccgcaacctttttggcaccagaaaccagtttcatggaagacaatttttccagtgggattggaggaggatggtttccggatgaaactgttccacctaagaccatcaggcattagttctttagattctcataaggagcatgcaagctagatcccttgcatgcacagttcacaataggttttgcactcctatcaggatgtactgccattgctgatctgacaggataccgagctcagatggtaatgctcgcttgctagcccactgctcacctcctgctgtgtggcccaattcctaacagcgtacagactagttctggtccgtggcccgggggctggcggctcctggcttaaatgatgaaatttgctgccactgtttaaacactgactctttcacttccccagcccagcctgtacaatcttctgctttaccttctttaccttagccctttgtcccagtttgggaacagtgaaactgctggcaatcccagtaattgtcttgaagcaggcaggcagacagaatgggaattcaggccagggatggtggctcgtgcccgtaatcccagcactttgggaggccaaggcgggcagatcatgtgaggttgggagtttgagaccagcctggccaacatggtgaaaccccgtctatactaaaactacaaaaattaggcaggcgtggtggtgcgcacctgtaatcccagctatttaggaggctgaggcaggagatcacttgaacccatgaggcggaggctgctgtaagccgagattatgccactgccctgcagcctgggcaacagagcaagactctgtctcaaaaaaaaaaaattgttttaattaaagaataatttaaggctgggcgtgctggctcacacctgtaatctcagtgctttgggaggctgaggcaggcagatcacgaggtcgggagatggagaccatcctagccaacacggtgaaaccccatctctactaaaaatacaaaaaattagctgggcatggtggcaggtgcctgtagtcccagctacttgggaggctgaggcaggagaatggcgtgaacccaggaggcagagcttgcagtgagccgagatctggccactgcactccagcctgggcgacaaagcgagaccccatctcaaaaaaaaaaaaattaaaaattaagaatgggaattcagatacaaaaagagttgtcttctgcgttaaccgcagcacagggagagaaaaactacatctacccacagcattatagaaacggcccagggcaactacatccgtttgatggcattatagagatggcccagggcaacctgagtctgctttttcatttgtaagttagtgatgatatatacacctgacccaggtgctacgaaaggacccagtaagcaaatgctgagacaacacccagtctaggacttggcatcaaataagcaaccctataaatgccagcacctattacggttgttgttgtcatttgggtgataatggcactcaccaaattaaagacttttgagatcactggtatccatatcacactgtaaagtagaaagaagtctatattttctcagtaccactttaatgttaatttattacttaagtaccaacaaaacttcaaacaatattagagccagaggaaatattagagatcttcctcgaatgagttcggtgactttctaagggcacgcagggagtttatcgggaaggccagggctagacaatccaagttcccacagagctgataatgagccagaagtgggccccctacacacaggcatacctacttagccccatctgtatatcccaaactcacacagcctctttaataatcctcttaatagcagtgataactaaacatattcagctttaatcacacttgcacgcatgccttcttccttaaatctaagtaatatccctgcagctattccaaaaggaacactataactggctatttgccataataaggatgaggaaattttggttgatcacattttaaatgggaaactgtatttagagagattttaaactgcaaaattaaaaatgcaaacgtgaaattatttttccattaagtcttctccttggggaaatctcttcctctgttgcagttgggcggtctggatgggctggttacccttgtgtggggtgtatagtgaaacatcaactcccatgaggctcattctcaggggttgagataatagtagtccctagtggggtcgtctaagagcccttgggagggcacttatcttcatgtatatattacataaatcttatttcaaaagggatttctactataaatattagatcatctgtctctaaattctccaactgtttccatctatctctaaatttcccaactatctccatctatctctaaattctctgacagtgctgagatgtaacgaacagcattaaaacactaagcactgaaaaagagttatcatgctgaacacagtgttgtttttattctaatttctaaatccatgtctcgtttagcattggttgtagtcaagagagagactgttcaatcccagtctccccatgccttttttctttgttcattatggtgaagggatcatggctatataactgtttaattagcaggagtcaccttgagaaatgtcaccagggtggtcctgctcagttactaatggggtagttatatataaattgcttggtccacctgactgaaatatagtggattcagtttagggagtatgaaaatctcagattagaagagaagatggaggtcattccacccaaaccccctccccatgaatacctctgtcttttttttttttttttctttttcattgtagatctaggcgagcttgcttcttcaggaagttaagccccattgttaggcatctctgaagtacaagcagtacatagtatttatggttggaggtcagactctgaagtccagtgtacgtggattggaatcctagctttgcagtgtacaagctaattggatgacatatattaaacttattaacaggctttgtcttttgcccagaaattttacttctgaaaactagcctaaaaaataataaaaccttaatatttgagtttatatgtataaggatgtttgttgaagcattgttttttgtaggtacaaaaaataaaaggttagatctccattcacactacactgtactacatccattctaggaaatactatatggctttaaaaaataactgataatatctatgatttactagcccagagcaatgtacacagcttacataaagaaatgtgcatgccatttttttgtgaaaaaaatcataaaaattccctgtgtgtgtttttataggattctgtaaggatagtaaaagacatggatgatctgtactactgttttctgagtaatataaatggaaatagagattttaatacaagcacaaaggaaaattatgcataacagaattttatctattaaacgaccacataaaagaaaaatacaatattgatattgattttaaaaaagatgaaaataaatgtcaacatattgaacatttggtcaggtgattatggagcgctaatgtttttcttacatttctgttattttcatatgtatttgtaataaaataacgttattaaaatcacttataaaggaaaattagaaactacagtcctagttaagtaggagtgcaaaagaacttgtgaaatggggtcgggtaagaatctagtgacttctctggagttgcaagcagagggtgcctgatgcagacactgagctggacatgaagcatgttctctgaagattattgtctgtcttccttctaaacccatggctctgcgtacctgttcctgctggcccttgaagaggttcatatatttgaaatgagcattttgggggtgttcagcttggtgctattcatgataatttgtaataggttaaatgctttcaattaaagcttaagtcagtgaagctctcagttgagaaatatcagaaaattgagtgcactgtaaagtcagtctctgtaggtctccatagcttgaattttgtggagtcaccactgagctgaccttgtgctgagttttatgattctcatattagacaccttcttacacattcagatggcatttccagctggctgtctaaagttgcttcgtagtcacggaatcaggaccccagaacagagagccaaaattgagcactgtttcctgagagcactgtggctctgtccttgaggacagatttggcctgtgttaagttgttgatgagcaattgttaggattaatggtctctgtgagtctactccttctataacccagcacccaggctttcacatcaaccacgcaccaaccatcacagcagctgttttcaatctgcccatcatcttaaccacacacacaaggctgcagaattcatctcattaacttccttattttgtaatggaagactgaggttcacagagggacagtgactttcccaagtcactcaactggtcctgacaaagaaggactagcctatggcaatctcagattgccacctctatgttgaaatgacatttaccagtaactagccccttggcagagaggaacccatcaggcaggcggtctgtgcatggtgggtcagaggcagagctgtgcattcacacagactggattcaaatatcggttccttcatgttttagctttgtgactttcgctgggtcctttgatgtctccactcctccatttcctgtcctctaaagggggaatgctggcagtgtgttttcatgggatagttacgagcattaaataactttcttccggtaaagttcttggtgttgtttctgacatctaataagcaatcaaatgttacaactgccaccaccatggtagcacatcctcttctgggtaacacctatgttaaatcaacgtacatggcttgactcaggtgatatctgtaatcttgactttgtctgtttacatgtaactaggcctctggtctctgccatcctataaatccattcagcctttcagcctcagtttctcctggtagagcctggcatggcctgaaggcagcacagtataatagaaataggaaggtgtgtgtgatagactaaaagatggctcccccagacacccaagtcctgatcctggtacctatgactatgttaccttacacagcaacagagactttgctggtgtgattaagtcaaggatcttgagatgaggggtgaggggcttataaagcggagtttccctgcacaagccctcttctcttctctgccgccatgtgagacatgcctttcactttccaccatgattgtgaggcctctcagccagatatgctcaattatctaagttgtccctaaatgtaattacaaatgtccctacaagagggaggcgagtggtattgactgaagaagagggaggaggcaatgtgatgtggccactaacccagaaatgaattcagtctctagaagcaaaaaaggcaaaatatacattctctcccggagcctttggaagcagtgtggccctgcggccaccttaattttagcacagtgaaatggattttggactcctggcctccaaaactgtaagagagtaactttgtgttatttcaacctaacagtttgtggtaatttgttagggcagtcacaagaagctctgatatggtttagctgtgtccccactcaaatctcatctttaattttagctcccacaattcccatgtgttatgggaggcacccggtgggaggtaattgaatcatgggggcaggtctttcctgtgctatgcttgtgatagtgaggaagtctcatgagatctgatggttttataaaggggagtttccttgcacaagagctcttctcttgtctgctgccatgtgagatgtgcctttcacctgctgccatgattgtgaagcctcctcaaccacaagggactgtgagtccattaaacctctttcttttgcatattgcccagtctcaggtatgtgtttatcaacagtgtgaaaacagactagtacaagctcatacagtgtagaagtcactcctcaaaggtgacttctgtcaccaccctcaccccaagattagaagagttcccattgcaccttgaaattcattttcaaagcattcattgcacttgggactattagtttaatgcccagcacctggaaccagtgcttggaacatgggagtcccttaataaaatgttactggataaatgaatatttgtcttcccagagagacagtgagcttcctagaagccacatgcgggctctttgctgctgcatccagagtgcctagctcagcgctagtgcatggtagcttctccataaatatttgctgaatgaataaatggctgcttgtctcctcaagtagcctatcagctccacattcgccatgtcagtttcttcctctgcaatctctgcagtggcttgcaccatgcctggtgccttgtaagttctttgcaagcaatcattggccatctgcctgagtagtcacgctggtccggacttgagcgatcctctccctctgtccctttgcactagagcagttgtcccattaagccatgtgaaccctaccggtgtgtgttatgagccatgcgttgtgccaacatcccggcagacggaattcagcagtgccacgggagagagccagcggcctcccctgcatctgagcagcgtggcttgttagttcccagtccttcagccaccagctgtttctaacacaaactcgtggtgacagagctctctgtaggagaagctaactacaattgtcagtctgcagagcatcaggcatctctaaaaggattccaattattgttctgttctgcctgctcctattacagtctacctcaacatcagctcttattcagggagaggagagcgagatgctaactctgtctccactcactcttatgccagaggaccagcagatgccagcagctggtgtcacgctggagaagggtaaacataggtaaacttcccctcaatgcgacggctcacttttcattggtgtgtattgcacttaaatgtgctcggaaaatctcaactcagcgtgactcgcaacctcaccactgagcggaagataaatactgagatgcccagaggtgagtcatttttacagggcattccccaaagacaagatgggaggtgcctcccacactcttcacctcctcctctgtgggcagcaggtccctgcctgaagccgacagacaggaagtcggatctgtgtaggtagagttggcaggtttctcagctctcataatagctcatgggcattgcagtaaggacccagcacaaggaggtggtggaatggcacggcccacggcttccttagttgtggaagttgtgaggatttaagtataatttacattatcttttttttttttttttttttgagatggagtctcactctgtcacccaggctggagtgcagtggcacgatctcagctcactgcaacctccacctcctgggttcaggtgattctcttgcctcaccctcctgagtagctgggattacaggtgtgcaccaccacgcccagctaatttttgcatttttagtagagatgggatttcgccatgttgcccaggctagtctcaaactcctgaccccaagtgatccgcccacctcagcctcccgagctgctgggattacaggcatgagccacagtgcctggcacgttaatctattttaaaaatctagttggacttatttttaaacttgtttgtcaaggcaaaattcacatgacataaaaattaaccattttaaagtgaacaattcagtgccatttagtggatggacagtgttgtataaggcaccacctctatctatattctcatcgcccccaaatgaaaaccgcatacctgttaagtagttgctccccatcctccatcccccatgccctttgtaatcatctactttctgtctttaaggatttacctattctggatgctccatacaaatgaaatatgcaaagaggagcgcattaggaaggtggtctgttcatggtggttcagaggcagagctgtggatcctcacagcctggattcaaataccagtcccttcatttttcagctttgtgatcttggctaggttctttgacctcttcatttttccttttcctgttctacaaagggaaaatgctggcagtgcattttcatggggccgttacaagcattaaataaccttcttcaggtaaagttcttgctgttgaatctgacatcaaataagccatcaaatgttacaaccactacctcctcttcctggctagcacctatgtgaaatgaatgtacatggcttgactcaggtgatgcctgtcttttgtggccttttgcgattggcccctgtcacttagcacaatgttgtaaggtacgtcatagtgtttactgatccatatgatagcagaggtcagcacttcttttcatagctgaatagtattccactgtatggataggccacattttgtttgcctatcctttcactgatggacatttgagctgcttctacttcctcactattatgagcaatgctgctatgagcatgcatttgcaaacagttattcttatttaaatgtgaattagcagtgcgtatacacacccaaaattgggtcatcaaagccatgattttattgataatgatcaaggatttcttctttacacaaattcattagagcacaaatgtcaatgtctaggacaattttataggacaatctgaagaaagcaacagctcagctggaatgtggatatggttgaagtcattagtttaatcatatctgcagagtttcttttgccatataaggtaacactcacaggtcctgggaattattaggatcaggatattgttggggtcctttttcagtctgccatatacactgtggcctgaaggttcattaagagttaactgggagaccagagcataaggggtgctccaggcagagggcacagcatgtgcagaggccctggggcaagaggcagcctggtatgtgcaagaagaaaagagatgcacggctggaaagagacacaggcttttattggccaaattaaggacttgggtcagcatccaaaggacaaagagataccactaaagaatctcaaaaaaaggagtgataagttgattggcattttagtagatgctgtggccacattgtagatgggcaaagtagagggaaataattgtggattcagaagaagttaggaagctgttgcaatagttctggtgagaggtggccaaggcaaaggttagtgtgtgaccgtgaggaccaaaggaagaggacagtcacaggcatctgtgacttacagctgaccagctctgctttgctacttcattcgttgattccacaagtgcgtattgagatctcaacatggggaaggtgttatgcatggtgctgggaatgaaatgctgagccaactgtgcagtcctggacaggttaattaacatttaggcctcagtttccccaagatatgataatgttcattttttttggagtgtcatgaatattaagtgagtgaatggaaggaaagagcttaggacagtgcttgacacagaggaagtatttggagcagcaagcaagagaaaaagaaggaacgaaggaaaggaaggaagggagggagggagggaaggaaggaaggagagaggaagagaaagagaaacaaagaaaagaaaaggaaaaaaaggaaagaaggaaagaaggaaggaaaggaaggaaggaaggaagaaaagaaaagaaaagaaaagaaagaaacccatggacacccacagaaacaaccaccctggctttggccctcctctctctagagtagtcattgaaaaattcacccaggacaacatttgcatgaacacccaggaaatgggtggcatatggcatttggcattatgaggcattgagaaatcctttccgtaatatccactgagtatatactgtgagccaaaactatgatagcggctatgggggaaaaatgagtaaaaaccaacagtcattgtcttcatagagcttacaatgtagttggggggaccaatattagtcaaataagcatagtaagaaagatagtacaaggtaagagggggaagaccatgttgcaagagagtctttggtgggctgagttgacctgaccacggtagtcatggaaggtctccttgtggacgtgatccttggggtgaatcaagaggatgaggtggtgttaactgagcaagaatgggtagaaagaacatcacagggagagagaaaagggtgagcaaaggtcctgtggccagtgggaatgcagtgagtgtgggtgtagataaggctggagaggccaccaagagctgaacacccatggaaccttgtagaacaggctgatgggttttgtctttatactaatggaaatgggaaatccttaaagtatattaagttatatggagatatatacagagatgcatctttggaaagatgattctggtttgagtgttaaggggagatggagaaggagataagagaaatgtccactaggggactaccatattggttcaaacaagagacagcaattaggtggtagagatggggagaaggtgccacttcgagggctgtttaggagagaaaatcaacagcagcactagtgataaattgagcagaagaggtaatggagggtcaggtggccaggataacaccagcatttcttgactggtgcaatcgaaattgaaatggggatgttgcggatggaggtaactcatgccacaggtgtttcatcttctcagtaaagcagaagcctggctcatttgctgaaaaagagtgcattgagaactaaggcagaattttaaggacgtacaaacatttttgaatggcagctgtggggattcgagcaacaagaatgacttgcagaagtgatgacttaattgaaatcaaattgaaatacatagaaaccacagatttggagtaggcatttcatttgatatgtctcaaaggcccagcaggatgctctatctacaaagaaggtacagaataagtatttgttgagcaagtagataaaaccaaagagcgattttgcatgactttcctgagccaactgggacaatgaattggctgatctatgcacaaaaatttgtcctgctatatttctttccatggcaatccctgtgtagaactttaggctgcaacctaaaggtgaaatgcacttaatttggcttgaataatttacttggattcttccttatcaacaagacttgaatatataatgtatttgaatttgaatttggtagttatatgattgtttaattcttggggattggaatatgagggagataggaagaaaaggaaaaggaaccatttgctcacactctggcagatctaaagaaggtttcattactgtagggcttctcagaactttcagtaccctaagacagaagcttcttagacattatttgttctacaggaaaaaaaaagtgttgcaaagaatagctacatatagttattatctaatatagtggcattctatggaaagaaataaatctatattagattaccttgaatttgagaatatcacattttagccccttggaaggaattgtactctggaattatatctttggaatatctgatcaggccattataccaatcttcccatgtttcctaccatatttctaaaagaatattattttataccataactatattcaacatagtgcctatttctctattgccttcctaggaatttaattttgttgtctaaatgggggaagtctgtttcctttcccagttacggcccaaataataaatgttgatgttaccgtgctataaaaatatgtcctctataaattgctttgcttgtcattaagatgtttcctaaacaagttgaatatgcgctatgtttttgccagacacttgaagcaatcttaaattacctgctgtgtctacacatattcagaaggccataatagaaatgtgccgagtggctcaggagaaaatcatttataaagattagaggaggacttgggaagctctgcctcttgttgcttggattgtgcacaaatacatttatttctgggtatgtttaggttatttcttttcagatttattttggtttacaccgtttcccaagcattagtcatcactgtcccctgaagcagtcacactatactcatctccgtagatgatcaatcagaatcttgagagtgaaatgaccagttaagacagaccaacaatttgttgatctagtggaggcggaaaaaatgcagtctgaattgaaatgacttttatgagatttcacccaggtggttgtttctaaatttatactcaaaatatagagtgaaacttgagagaacatttgcaagaaggaatgtgatcctaaaataataggatgtccttgttgggtgagttgaggaagtatgatagagccatagaggaaaagggtagattggcatcgacttagtagcgctgacgatcatttttatcagggatgtggatgtaggcacagaaagaaaggcatagctcttagattagcagaagagacaaggttggaaggaataattgtccagttagaatgcataatctgtttttaaagacatattaaactggaataacccatgtacaagtatttatccagcttggatacctggaagtggaattcctggttgaaaggtatattaatataaaattttgtaaaaaaatatatgttagataatgcttagtcatccttcgcaaatatcatgccaatctacatttcaactaccagggcacacacttgaacccatataaacagtggtctattctgaggacttttcagaacttttattaaaccaagattcattgtaaatctttgagggagtcatctggcatacaaagtgttttcgaaactttgattttaaaggaactcatactaacatcttgagaatctagtatccttagaacagtggtccccaacctttcttggcaccagggaccggttttgtggaagacaatttttctgtgggcaagggtgggggatggtttcaggatgaaactattgcacctcagatcatcaggcattagttagattctcataaggaacatgcaacctagatccctcacacgtgcagttcacagtagggttcacgcttctatgagaatctaatgccatggctgatctgacaggaggcggagctcaggtggtcatgctcactcacttgccactcccctcctgctgtgcgactcggttcctaacaggccatggaccagcactggtgtgtagccagggggctggagacccctgccttagaacacaattcaagaaatgctagtccacatgaaagtgaaaggctgaaaacttgcagaaaaggaaaaccgaaacattgaaagagggaaaatctgacaggagaaggcacagagatgagcatgagggccatttgttgaagtgttggtaacagcgataatgataattctagctgatattttcagagcattttctacgtgtcactcatggagtcctcacaagaacttcacgaaataggtactgtaattattcccatttcatagatgaagcaattgcagcatagggagatgaagtaccttgtccaaggtcatgcgaataggttagacttattcactctgtgtggccccagaggaggaatggttctagaaagaaatattttagcttaatatttgaagaagggctccagcagtcagaaactgggcatcatctattagggatatctccctgagggagaatttgagcgtgattaattccctgacattccattggtggaactcattctttgactttagataaaattctcttgcttctgaatctctgctaatttaggtggtttgtcctggacaagactgatttttaaaattctttatgttattgtcaataaattttttttttttttttttgagatggagtctcactctgtcaccaggctggagttcagtggatccatctaggctaacttcaatctccgcctcccaggttgaagccactctcctgcttcagcctcccgagtagctggtgttggaggccgaaagattgagggtcgtgatcaactcagtataccactggaggctatatgagtaagcgccaaactggtcttcataaatgcagaatgttggcagaccgacaaactgcgtctgctgccccgaaggagtgctgaagacagtcacccccgatgcgcagtgtttcttgtgattaggtacatctgaagcctgttagtaataatataaacctgtgttcagttaagcagctgaccagtcattaccacctcctccttgctctttctacccaataaatacaaagggctctagaagctcaggggtgcctttgctcactagaagcagggagctctcttcttcttccccagacccttcctttaaaacagtttcttttgtcttaagtttccatttctacgtttgtccctttgttcagtctcgtaatgacactctcaagtagtaacagtagtaactgtcctaatgacatctcaagtagtaactgttgtcatgatggtctcaagtagtaacagtagtaactgttgtagtgactggtctcaagtagtaattgcggcagtcagccacagctggaattacaggcatgcaccaccacacccagctaatttttgtatttttagtagagatgggttttcaccatgttggccaggatggtcttgatctcccaacctcaaatgatccgcccgcctcagcctcccaaagtgctgggattataggcgtgagccactgcacctggcctattgtcaataaaatatttttatatccatgatgccagtttgtttggtaaatgtgactacagagcccagggtgaaaagatgtagaaattgtcttgggatcatcttgacgtctcctggttggagtattcatgttcactcccgctcaatccccaggtcatatggcagtctaatctcagactctcagcccagctgccacctccagcctctggcctacactagtgcccagtggtgagcaaagatgttgggaagaaatctggatgcatctaaccctgctgcctgttgagtatcaggaagctgcccaacactcttccttagaaaggttttaacatgtcataatattgaggcattgaaaatctaaatgaattcttctgattgttccagagaagctatggaaatatgatcacttcattatcctttaccaaatgttcattgcatgtcttcagtccctcacattcccaccagctcctctcttctttgcctgaccaaccttactcatcctttgaggcatgtggcagagatcgtgtgttcactaaactctgtttgttttcactcttggccatagttagacttaattttccaaagttccttgcagttaggcagggccatgaaacagacaatggaatttggtagaagtcatcaaaccactccttcctctcctcaccttctttccccatccacaagctgaaccaaggactccaaaggtctagaggaaggcacagcccaagatggaaggacctgaatccctgactcccccaagacattgagcaaagtggaagaaattcatggttggtttttaagctctttagaaacagtggtttatttgttgcagcagttaatgttgctctgcctaacataagactctgctctaccacatcaggtttcttcatgggtaaagtaaggtcttctcctatgagaatgtatagagccctagacagagcttgcatcatagctttagaatgcaagccccatgggacagaggctgtgtctttcttatccatcattgtacccattccctagcaagtgtccagcatttggaagcaagtcaataaatactagctattattgctattagtattaatgtgttagcgttgtctgacccttgctccttacagtgtaggccatgggccaccatggcatcaccccagagcttgctagaaatgcagagcctcaggcctcatgctagtcttattgaattagcatctgcattttaacaagactctcaggtgaggccattcctgctgaggtgcacatactaatatttgaaagacatcactctagaccagcagttctgagccttggttgcaccttagagtcaccctatcagaattcctatcagaatctggttttgtttttgttttaaggcttcccagatgaatgtaatgtgcagccaggattgcaaactactgctccatctcagtagttctcaaacactagcctgcggcagaatcccctgggtgttaggtgcgtatcacaacacagattgctggatcacctccccacactgcctgattcagtatgtctggcatagggaccaataacgtgcatttctcccaacttcccaggtgcattcgtttgcaacggctgtggtaacaaagcatcataaactaagtggcttacaacagcagaaatgtattctcccatggttctggaagccagaactctgaaatcaaggtgttggcaaagccatgctctggcagctagtccaggggagaatccttccttgtgtcttccagcttctgatgtttgccagcaacccttggagctctttggcttgcagaagcatccaccactccagtcctctgtctttacacggctgtctccgtgtgtgtcttcacattgttttccttgtctgaacatctgtctctgtgtcctaatttctcatttttataagaacaccaatcatattggcttagggcccgtgctcatgacctcattttatcttgtttacctctacaaagacttcactttcaaataaagtcacattctgagatattaagggctaagacaatcaacataagctttttgaggggacataattcaacttacaacagcaagtgatactgatgctgctggtctagcaaccccagcttgagaacgactgccttgttgtgagctgcaaaagtgcaaagacaacattcctttctttcagtacatcctacccagagtgtagcttggcgcttggcacatcgtatgttttaagtaactataggttgaattaattaatattctttccacacagcaatttggcctgcataaaagacttcgatattttcctgatgttgccagaggcttaatgtgtgacatttcgtatagcaaatgctcaataaatgttgggtgagtgaacatagctgtcactcctcattacatattttaaaaacaaccttagtgggccttcatgcttttattccaccttatggagcccaatgacagaatgctgattaaatgacatggctcctttaatgggaaattaacaatctacaaaatgttgtggattcagtaataggcatttgaggcgctgactatgatgatttgttgcttgccttgccttgattccccagtgagaattcatctctatttagcaagtgctgtgatctactccagtaaaggagatctctttctttgaatcccagcaacctctagcttggtctttagcttcatatatcactgttaattttcacctaagtcagtggttctcaactgggggtgattgtgctcctcaggggacagacattagagacatgttttggttgtctgtcgtgagagcagagtgtattcccattccccagctgggaccagcgggtatgctgctctcatctaatggacagtggccaggggtgctgctgaacatcctacagtacataacacagttctcatcgctacagagaatctctggccccaaacgtcagtagtgccagcgtagataaaccctgacctaagcaaagacaaaatggacatgaagttgcctcaatgggcaagaccaagacttctgagccaccccatcagtgacacttgatgtagccggtagcaggagtgccagggagaacacagctttgttgttccatatccagctgtttggatcagagggaaatgggatctttcaatcactactgcagtatgagaaagtgagctgcacccagtggttactaggtggggtgctctgtgcagtgtgcttcgagcacaccctctcactgaatgtgagatgatgctcccactcgcagtgtctctgaggtgagaactattacagtccccacattgcagaagaggagtctccagcactgagactgagtagttcacccaatgtcatatagggtggagtgttaaagtcctaaataaaacccagtctataggacgattgagtctgtgattttaatccctgtgtagtctgggtttacatttccattcagattcctgctccaacatttcctatagatgctcctcaacttacgatgggtttatgacccgataaacccatcgtaagttgaaaattatcattaagtcaaaaatgtatttaatacacataacctgctaaacgccatagcttagcctaccctaccttaaacacactgagaacacttccagtacagtattcaataaattacatgagatgtttaacacttcgttataaaataggcattatgtcagatgattcatcccaacatcacaagaggatatggcaccacatgttgctaacccagaaaaagactagaattcaaaatttgaaatacagtttctattgaatgcatatcactttcatactattgtgaagtcaaaaaattatgagtgaaatcatcgtaagtcagggactctctctagctgcattgtgttgggcaagggatttaaccctcaccgtctttgtttcctcatctgcaaaatgaggatttataacagttcaaagggtatctactaggattaaaagatacaaaatacatctaacaatgtctggccacagtataagctcaataaatgttagttcttctccccgttagccgtcattacattcacaggtattaagaaagagaaatgtataggtatgatatgtaattctcttagttaatgagactttccttaaactaactagaagattccattcactggaaacatacttaatgatgaagcttttattctgttcatctccttcagggagtacttaaaaataactcacaagcccattgttagagctcatgttctttacccaaccaggatttaattagtccttcagctccttagcccttcttagaagttgttcgatgttaaatcccacatgacccttgggtgggaaggtgtggaaaccctccaagcaccatctgacatacccagtgactaggaagacttcacagtaagagttaaggatttttaaagattgccgatgttaatgaagaaggaaaaaaaatagtggatgtgctaaattagatatttacaaattatgttcctctctccaggggaagattcattaattttcaccgtaaccagcttcattctattgggacaccagaggaggatttgcagattacagatccagccacatctttctcatgcttaaagaagtctcattgtctgcactgtccagagaggggaaagtccactgcctggacaaggccttcatggctgttcacaacctgccccagcctccagtccattacccttgcctattttgttgcagtgatggaattaaagtccttctaatgaaaaaggctgtaggtgaattttaatccattagccatctaccagacctcctctgccatcctttagactctccatacagttcctctccctgccgtatcttcttgtgtgtcaatatttatatcaagcaagccctcctcatctgcccaccctttatctgccaggctaagtccaactcctacttcaagaccgcattcaaataatgcctcctgtctgcagctttcctcagcttccccatggagaattgatggctccctttctttgagcgtattcattcattcattcattcattcaatgacaactatctaccaggagctgttctaagcattggggtgtggaggtgaacaagaaagcatagagccattgttctagctggggaaccaatatgaagtaaaacataagctaatacttaagtccagaagttcagaagtgataagtgctctgaggaaaatatggagtgatgaggaagagtgaaattggcagagtgaagagtgatatttgatgaggcaatcagaaagagccattgtgaggtgaggtttgggctaaaacctgcataatgagagggaagcatccatcctccaagtgtagagcgtgggacgtcttggtagatacctcaccagctcttcccttctcagaggctctgaactcctggagggtggcactcttggcatccccagactcttggcatccccagtactttgtccggaattcatgcatagcagcagatagccacaggtgatggctcaagtgccttcatttaatttaacttaaaattttattttcggttgtacctgttatgcatttgttagccatactactggttttttttttttttaatcaaagaagaaaatagctattgcttcttttttttttctctgggttcaagacgttctggaaacaaagtttgaaaaatccatttaggaaatgcaatttaagtgccagataacatcttgggattggcgccatgatcgatgaggtctgggtataaccaacgtcttatgccatgtctctgatctttactcaaattcacctcctattctgggtagcgaagtttggggagacccagtggtgtggagagagggttgtgtttagcttctctttccctgacctcagagtaaacaccagccatctgcataacagcagtgcccttccatagtacttattaggctattgttactcagttgatgtcagttggtgccactagacagagggcactgcagccccatggccatgtctgtctttctgaaagattcaagtgccagtctctttgcatctggcacacagtaggtactctgaaaagacttgcaaaatgcagaaatgaatgaatgaaggcacaacaaaaacacggaccggaagggacacctccggtcctgaacagcctggcttcaacttcaaggaccacagttggcttgaattttaatccatcaggtcatctccatgtgttcactttcttccataaaggtgaatgtgtcaagcactgtgcaagctgccaggagaatggtggagtatgataaccatctagtgggggaggcaaacttgaatcgaatgatggcacaaataagtgtggaattatagagtatggtaaaagctaagaaggaaaggcaaacagggcttcaagagtacacagcagtgagcctggacccagggggatgtgggaagcccaggaacctggataagtggctgttgttgtttaatctattttttagctttcattttagtttcagaggtacatgtgcaaatttgttacataggtaaactcatgccatgggggtttggtgtacagattattttgtcacctgggtactaagtatccaatagttgtttttttctgatcttcttctcccaccatctaccctcaagtaggccctagtgtgtgttgttcccctttgtgtgtccatgctttctcattatttagctcccacttataagcgagtacatgcagtatttggttttctgttcctgggttagtttgctaaggataatggcctccagctccatccatgttcctgcaaaggacatgatctttcttttttatggctgcatagtattccatggtatatacgtaccacattttctttatccagtctacagttgatgggcatttagtttgcttccatgtctttgctatagtgaatagtgctgcagtgaacatatgcgtgcatgggtctttgtggtagaatgaagtcactgttgagccttgacctccaaggctgaaatagataaaggagtgaggagggtgttgtagtgggaagctgtggcctgcagaagctatcctggggcatcaggagctgctgggggagggaaatggtataagacagcagaccaggcagaccaagactgggttctgtaagctctgctaggaatcttccttggtatctgcagagcacaggaaagcttttgagagatttcagtggggagatgatatatgcagagctgagtctggaattatcacctgggctgcttgctgccagatagattggagcaggaagggggggatgggaagctagccaagagcaggtgtccaggtgggagagaatggtcacttaaacctagtgggggtgccagggtggggagaggtagacagattgaggtgatatttaggaggcaaactcaacaggccttggtgatggcttatttagctcagtggtcctaaaccagggacagttgtgtcttccaaggaacacctggaaatatccagatattttttggttgttgcaactggctgggagattggtgggaaggggatgctactagcatttcataggtaaaaactaaggatgtggctaaatatcctacaatgcaaagggcagcccctcccccaacagcaaagctttatctggccccagtgtccgtagcgcagtggttgagaaacctggcttcagatgtagaaacatcagagatgcagtgtcagaggtgatctttgggtcttgtcttgctaacaaggtgaaaggtcatgccattctctgagatattgggaccccggatagccagttcttttacaaggggtatgtggtgtcaatggagaccagaagatgggttcctgaggcatttggagacatccaagtgaggagatggcttgttttcttcctaaattttcaccatcccccacaaggcagcctttttttttctctgttaatgaagtttccagccaccttacccttgattctcaccttccaaccccctgccttccaatattccacccctcttttttctgccctagaggagaaacctatgatccttgcattagaatggttttcctgccatcactattgcaaaatagacaagggtaaaagaaagccttcagtagaatttcatctgagtattttctttgcccccttgtgtgtcattttctccttaagaaaactgaggaagaagtgtgatttagtcccctcatctgcataattttcttccctgtgtggctgtgtgcttgtcagtgctctgacagatcaagagtgctctgaaagctcagaggagcaggaagagacccaggtgacctggtgagagccacgctgaatctcggttcacatgtcgttaacggagcttggtccttggagggccttgtggggaaggacgcagacaagctgtgatggagtccttgggtctcacctgggagagcccacgggagcacctgtgagttggttccgagaaaacatcccactctccaggtcacctctctgtgcttcaccccacctctcattcttcttttgtgcaaagcacctatttggaagtaaaatatcagctagaaaggaaaggagtttcagaagaaagtaccacatcagcgttttgaacaaattaagttgtgtgcaagctgagcagcctgtatcaaggggaacgtggtagagggatgtgagcctcaggctgcctgctgccggttgcaggctgccatatgcttcacctgcttgtgccctcgagggtccccttctggggtccccagtctggcttatgatcatattccagcatagagcactccctaaccccactcccgtagcactgggactatagctttatttcttgcatcatttttctctacgctcaaaaaaaaaaaaaagcaaaaacaaacaaaaaaaatctgctcagcatgagaaatcaagttaatgaaaacgctaccgcattgaatttccaataagagaaaggcaaagcaaaacttgtcaactaaagaaaggggcattcactgtaatcccttcgaggagaggtggaagcaggagtaatacaaaagctcattactgtaatcaaggcatttgtaactgttggtggcaggaggtgaaagagagagagagacagagaggggaagactctgacggaggttttaactgtatgcatgccagtctttcccactcgtcttgctggtacaatctggatcgttcatatagaaaggagacagggtttgccaaacttggctgaccaagccaaaaacactaattagcagcagctgctcaaaattggggatgctcttgccttctagtgcaggggtgatgacttgttctgactcttcaagattcacaaccttagactgcaggatgcactttgccaggggaaatgtattctccaacgtggctgtgtgcattggtgctcaaacattggtgaagccccaagtacttgagagggacaaacaaaacacctgtggaatctcttggtcagctggccagcaggagtttgaagccagggtgaactcaaagcattctcccaaagaagcctttttcaaccagggggcgctgacagaagttgtcaacacgtctggcaaagctttccagcatctgctatgatgtcttaatcctcctgtgaggagtgacagaggtaatgtgtggcatggagccatcagtgacatttggtgattgaatgttgctggtggcagtgtcttaatgatggagacaattgattgataggaggtcaactgccaagcagttaatccgatggcaaattccgctcataatggaagagctggcccatgcatgcaaaccagcatggtgggggattcctgctgatgcagctgtgggcacatgaggagggggaaagatatcaatgcctctgatgaatgtctagcaaagttttccttgtgaaacctcatggaaagttccatgaggccagagatcacatctactttgttcactgttctatcctttgttgctgacacatagtggccattcagtaaacatctgttaaatcgaggaagcagtgaatgagttggaagctgccttccttaggctgttttacttccagaattctactttttcactgacagtaagcctaacctctcaggttagaaatctaagttgccttgcattcctccctctctcttccccaccaagctctgcatattccatctcaggaataaatctctaacatttctcccttgtcttctttctctgaagccaatttgcatctcccaagtagtcttctgatgagtaagcctacccccatctctgttccatggcccccttaagtcatttatatctatctatctatctatctatctatctatctatctatctttgagacagcttctcactccatcatccaggctggtgtacagtggcatgatctcagctccctgcaaactccgcctcccgggttcaagtgattctcgtgtctcagcctcccaagtagctgggatcacaggtgtacaccaccacacctggctaatttttgtgtttttagtagagacaaggtttcaccatgttgagcaggtgaccccaagtgatccacctgcctcggcctcccatagtgctgggattacaggcatgagtcaccgcccctggcttaattcttttaacatgtaagtctcatcatgttacaaccctgctttacatagtcaaagtcaacaagtgttatttggccatagatatctcttaggccatgacaacccacctcctagtaccttcccagccttgggttaacttcatgtcagtgctcacattggtgcttcactgtgtgctgtgtcttacgtttcaaacacccattctgcatcttcttgtttcctaatctttgctcatgtattcactcaggctggacatccaagcttctcttttttttcctagcaaaacactgtctttgtttaagatgtgtcatctggggacctttttctgattcttgtcctcccttggagaaataaatgcatctccctttcctttcttccatttttcatcactttgtacttgaattgtcaatttgtctacccatctcacctgctggcctatgaaggtgtcaagtcaggggccataacatctttttcactgttccttccagcaactaatatggttcctggcacataattacttaatgttagttgaaagaaaaaatggatggatgaatggatggatggatggatgggtagataagtggataggtggatggatgggttggttagcgggttaataagtaatgggttagatgcatgacaaaatgaatggaataagtaattgaatggattcataaactgattcattccaggggaatactaagaaaatagcaactccaccacctcccaccttgggataaatgatatggccctgtccagggaaggctgagtgccctttgtcctcagacagtgaattctggagttccaggtacatgagcatcagggtgtgatctagaaaggagcctgtggacctagttgggcgtattctcttggtcctggggattctttgtgccatggagaagagcatagtttgagggaggtcagaatgggaggccagaacccagctgcttatgtctaaagccattatcttaccaggaaatgactaagacatatgggaaaggaaatgccaatctggtaactcctgtaactgtcagttccagtggaggatgcaccaattgctcgtgctcacatgctaaatcctttctccagacatcaccctggcatggccctccgtctcctagtcaggcattaactaataggggaaatgcaaaatgttgataccgcagaatatagagacagaagagattcacactgaaagtgcaaattactttttttgcagtgaatagaaagtcacattactctaagaagctgcctaattatctgtaattatgcccaaaatagtcaagctagtttgctagccagttgaagaattgcatcttaaatgaatttgtcactaaagaaagaatgttgaaacctggcaaaagagattactgcatttcaggggaaagattagaacatatcatgcctgtgttcagtctttcaaagacgtggttattggctgggcgcagtggctcacacctgtaatccagctctttgggaggccaaggtcggcagatcacaaggtcaggagttcgagaccagcctgaccaatatggtgaaaccctgtctctactaaaatgacaaaaattagccgggagtggtggcacgcacctgtaattccagttattcgggaggctgaggcaggagaatcacttgaacccaggaggcagaggttgcagtgagctgagatcgcgtcactgcaccgtagcctgggcgacagagtgagactccatctcaaaaaaaaaaaaaaaagtgactgtggttattgtaaacatttttgcttaggaagcatttattacagctgttcaatgtagcattttacggtattcggtggaaactctaatgtaagttcggagcagtcctaacattccaagagttaaaattatccatgattgggatgtaatatctaaattgaaataaataaactgtttttatatgaaggattttttcctgattcaaataaaggaatctagtttcattgtaggcaacacaggaaatacaaaagttataaaattcacatctgtaatcccatcaaccagagaaaactcttagtaactagtgggtgtttcttgctagctcttttctatgcatatgtttttcttataacactggaattttaatatatacaacattgtttagttacattcttccatgtaactttcatgagcatttttatctgccctgtaggaatcaaagtgatgggttttttttgttgttgttgtatttttttctcagatggagtatcgctctgtcgcccaggctggagtgctgaggcacggtcttggctcactgcaacctctgcctcttgggttcaagccattttcctgcatcagcctcccaagtagttgggattacaggcacccaccaccacacttggctaatttttgtatttttagtagagatggggtttcataatgttggctaggctggtcttgaactcctgacctcaggtgatccacctgccttggcctcccaaagtgctgggattacaggcgtgagccaccacacccagcccaaagtcatggtttttaaatgccaacataatattcaccatttttacatactgttgtttacttaaccaccaatttattgtagataattttgtgtcttttataggtatttataaacgattctgcagtgaacattcttgtacagatataattgcctgtgtctctgtctgttttcttaataatgcctaggaatggaattactaggtcaaaaggtatgatcattttaggaggttatagattagacctcaatgtagcagtgccatttctgtctgtgaatctttctttctagatctttctaaaccagggtatagaaatagaaggtaaaatcctcttggacagaaaagaaaagaagcagtgaacacttacttaaaaaaaaaataggcaatggaggagagccaaaatttgaactccagcctgaaaatcacaggatccctggagacaggaatatgcactggcaggcaacagaaagccaaacagaaatgagatcgaagaagagataggaaaacaaaacatttcaaaggaggcatagaaaggagcatataatggtgatggaggcaacgataagtaggcaatggaaagtagagaagaaaaatagcagcatggctgtgaaggaagggaacacgaacttctgcaaaagctgtcagaatcaaaatgaagccacttatgttaaaattttttttaattaataatcaatttaaaaccctgaaaaatgagctgaggagggttatgaagaggggagtctcacacttggttgcctgataacaaaaactgtcacaaaagactgcaaaaaccacaaccttgcacaaaggccatcacaaccttacacacacacacgcacacacacaaatacttctgcaaggacatctgcccagcaactgcctgtccaagtacagactgatgtcacccttattattgatctttgtagccagcaataactacttcaaagccattatgtaatcttcctcattttttccttcaaaaacatttgtctttctttacctccctgcacacacatacaaagttactgcagcacatgtattcccattgcaatgccctactgctgaatcttttttttttttttttttttagagaacctctccctctttgttatttaggttgatgcttcctgaggccacccctgtgccacacagacagaaccctgcggggccagaggtggagggtaggagccattgagtgaaaaagcaagtcaacatctaccagcttgcagcccctcactgaccatgttgtatacagagagagcgagctactttggtacttcatcaaccagacagttcagcagcttgaaagaggggagatttttccatgttgcagagtgacaagttgatatacaatgtttatggagaccatggtttgtacagtggtaaactcaagcacagaaacaggcataggggtatcttagaaccttgctgctcaaagtacagtccatggaccagcagcattgaaaacacctggaagatttttagactttcagaaaccaagaccctgcctgccccaggcctgtggaatcatagtttgcagtttaactgattccccaggtgattcatatacacattaaaatttgagaagtgctgtcttaaaagacatctttttatatgaatttcagactttgctggtgcttggatttccagtgttcactggaaaagccgaaagatttatgtgagcacttagttgactgaattgcatgtgattttagaagagggatttccagatgtaaagttaaaacatgatgtgtgatacttagcataagtggagaaaaccaattgataagcccaaggctaagtggaaccattctgactttttgagaaacgcaatctgtttgggggatagtttctaaagttcatcagaagaggtgtcattaaatcagattttaagcagaatatagcagtttggctaatgttggatagtctgtctgctcccaattccagaaagtaaaatattttgcaattgaggattgtaaacatcttagacagttgcaaggactgtacatgacatatccatgcaagagtattccgttctgtttctatcagcttcttatgctttttcaatgggaaatagttttggaataatgggctcattagagatagacaaagctatggcctgggggaagtaacactggtacccagagggttttaactgtttcactccctttcccagtgactcaaactatgcaccagtattaattttaaatgactttacaaaaagacttaatgagataaatcgtgtaggcacagtataaaagttagtctttcatgttgtgtctgcctgcagcagcgttctaactcaaacgttaggagaggcttagagacaatttgggtctagcatcaaatcagataaactatcatttttaattattgttattttgataaggacttcatagtctcttaagtaagccagccctaaaaatccttgctcatgtttttaaatggtaagggagattctgcaaagatagtatgaggaagcaggaggaggaggcaaatactggttaaatgccttgtctaaatccaccacagtcctcagcatcatcatgaacaaattgcagcagttatgcaccaagcaggatgcaaagcaggaaacacacattctcacatgcggtggtcaatcagccaagtaaagccaaagttgttgttgttcccagttcaaagatgaggaaattgaacctcggaggggtcaaataactcatccccaatcacaaagccattaagtggttctgtcaggatttgaatccatagcctaagttcatcaccacattcttctccttgtctcagtttcggtatttctcacaaatcaagggacctggagagaaacagaaactatttccacaacatcaagaatgtcacttagaatcaatattggcctggcttcgataacttacctaacagagaggtaatcttttcatggggcaccccacacttcacgccacacttaggcaagaagaaatgttcacagtctcagctgatgccagggaactttacagcaaaggaaacgttgaagcgcctcctgggctgtgtccctccatccctgtgcctctgtcatcctgtctacagattctcatgacagcaatgacaactctcaaccgattttctacataaggggtccccgacccccaggcctgtaggaaccaggccccacagcaggagaggtgagcagtgggtgagcgaacgaagcttcatctgtgtttacaggcactccccattgctcccattacttcctgagctcctcctcctgtcagatgagtggcagcattagagtctcataggagtatgaaccttattgtcaactgcatgtgagggatctaggttgtacgctagttatgagaatctaatgcctgatagtctgtcacgtctcccatcacccccagatgagaccatctagttgaaggaaaacaagctcaggactcccacagattccacattatggcgagttgtataattatttcattatacattagaatgtaataataatagaaataaagtgcacaataaatgtaatgggcttgactcatcccaaaaccatccccactctggtccgtggaaaaattgccttccacaaaactggtccctcatgctgaaaaggttggggactgatgttctatgtatatgatagaacatgttactgacatgttacattatatgtactattctgtgttgaagcaaacgaagctctctgtaagcctttcggaaatagtacagatacggaaacaggggcatctaaaagtcggccatcaggcactcagggtgacatactctgcttgccctttgttataggaaatgccctggagttgagtctgggaggtactgggaggtgtctcagcaggagataagcagcggggacttgccgtcttcctagatagtactgttacttggttggtacctttcatctcaatgcccatttgtgataccagtttgaccccagtagcacccaatttcagacttccccagccacctgtgacttagagtgagtagagaggcaattagggcacatgcttcgatcattttgagtgacagagtcttccagataaaaacaatataaaagagagactgctaagggtctctggggtgaagggtctatagatccgtcacttccacagggaagattgcttttcttggttgtttgctgagacctggggggcattgagcactgggaaatcaatgattgtacagctttatataaaaagggcacccagcaatgctcacacagtctacagggctcatttcttcctgaggcagaagagttttgctacactgacaagaatccttctggctggacacagtatgtcacctgttgtagaggggctagagtttgagaccatcacatttgctttctgcaagccctgaagatttaagagtgaacctacattgtttattgggatgttcgcaggttgtagtggtaagattggatcagcgcggtaccagttagcagagagggatgatgtttttaaagagtcttccagcagccacaaacatctatgaaagatacttccatcaaaaacaaagcttgaagtcaaaaaaaatggggaatttaagagcatctagatttgtctgttatgtgcaacaacttcttacctgactggttgtgccttgggtagtatcactggtgccttatgcatgaataatgtatgtataatgtatgtgtcactgccttagaataagcaacgtggaccacaggtcttgggcaccttaaataatttatatttaaaatctacatctagtcagagatgcatctgcatctacatgtaacatttatgaatgcaagtggaactttttttcccttttttttcaaaagctaaattgcctgtatttgagtgttagtgttccaattaatttagttgacatcatttcaactttgttggaatacctactacttacagtaagttatgtgggcccttgttatgaattaatgagagcaacagagaaataacttcagggaaagggtacatctttaaataatttacccacgtgggtaggtaggaaaactggatctgtggtcatgcgtagtgtgcgggtatccgaagctgggtgtccacagtcacatcgggtcctctgtatctgtggcacaagggcagacagagaggtcagtgtccaacaccatggaggaccacaggctcacctccctcaatggggtcagcatctcataaattagtcatgctggagccctctccaggagttcctggtgggagctaaagggaaggtgaactcctttcttttaaacactgctatcatgttaagatccactgccaggaactaggagggcagagtgaagacagagaaatgcaaagactgtattctgaaaagttaaggaagcagttctgtgggtgaggatagtgaataataatgttgtgagttgttttgatgagccaggcaatgtgttgatcacttcacatgtagtatggtctttaatttttatttgaaaaactgaaggccagacatggtggttcacacctgtaatcccaacactttgggaggccgaggcaggtggatcacctgaggttgtgagttcaagagcagcctgagcaacatggagaaaccctgtctctactaaaaatatgaaattagctgggcatggtggcgtgtacctataatcccagctactctggaggctgaggtgggagaatcacttgaacctgggagacagaggttgtggtgagccaagatcatgtcattgcactccagcttgggcaacaagagcgaaactgtataaaaagaaagagagagagagagagaaaagaaggaaggaaggaaggaaagaaagagaaagaaaaagagagagagggagggagggagcgagggaaggaaaaattgaaaaccctgaggtaggcaccttaattctacccatttttcaccttaattctaaccactttccagataacaagcacagagtggccaagcaactttcttactgtcacaaagaacagggattggaagccaagaagccgaaggcaccacagcgtctttttgaaacttggtgctttcgtgcctgcccaaattctctgattaagaaagaattagtttcctaattcttttatttttaaaataaaaataaaagattaaatcagatcaaacagttggccaatatacatgttggttattcacacgatggaggcctcattgcctgatacatcccatactgacagtagcagatttggaactcatgaaaccctcatcgcttcaacttcctgcaacaccccagctccttctaatagaacccagtgtctccttaattctttatgtgatgaatacgtattgagtagctactctgtgttagtccctggacaagagcagagcaaaggcaagaacgagataggagaggtctccctctcacagagtttggaatatagtagacatattcatagttctgactgggcaaaattcttctctcttacttttatccatagtttccagctctgaaacctaatgctacaaagataaaagttgcatttgatagataatgcaatggaacactactcagcctttaaaaaggagaaaatcctgccatttgcaacatcatggatgaacctggaggatgttatgctaagtgaaataaggcagactcaaaaggacaaatattgcacgttaccacatatgcagtgaatctaaaatggtcaaactcatggaagctgcatgggaaaatggttgcaggggcttgggggaggggattggtgtggtattagacaacagtacaaagtttcatttatacaagatgagcaactcctaaagacctactatttagagtttcacttaacattgtttctctgtaatgttgatgagaaaacaaaaatggtcattggtccctgggcctccctgctgtgtgctctgccgttgatgttacttagcttctttctctgtattgacatctttttgccttgctacctagttactaagtctctccaagtttctattccaaattcccaagagatcacaatgattgacgcaaccttaatcatatgagttggttcccctttggggtatgcccacctctggcccagtaagccatggtgctgtggcaaggacaagtgtaccataaggttggccccccccccgccccaggggctgagggttgggcagattaacctggaagggaaagggtatgtctagcaaattagaacaagtaagaagtatgatcacctgtaagttcatgctacattttctggaggtttttcttaattatttaattctcctctcagaccttctgtgactcccaaaccaataaaccatttttgtttggatgttgttcttttcttcccttgaaaaatactcattcaggttcttctctcattccttcaaaagagacttcaggccgggcgcagtggctcacacatataatcccagcactttgggaggctgaggtgggcagttcacctgaggttgggagtttgagaccagcctgaccaacatggagaaatcccatctctactaaaaaaaaaaaattagccaggtgtggtgacgcatgggaggctgaggcaggagaattatttgaacctgagaggcggaggttgtggtgagctgagattgtgccattgcacttcagcctgagcaacaagagggaaacaccatctcaaaaaaaaaaaaaaaaaaaacttcaagcaagggaggctatgctatcaaagtatattttcctcctcttctgcaaggggtctacatttaagtcaatagtagcacaatataagaagaaagactattaccagctaacatttattgagtatttactaggctatcagcactggtctaagcactttacaggttaaattcatgtattttctacaatgatcttaagcagaatttccttcattttcttatttccaaaattatactacctaatatagaaggtgatgatgaattttgagagataatgtacctgaatttcttattgttcatggtatatgcggaataaattgtgcctgctgattgctgtagtggtatcatcaactacaacattgttccacagctgagtggcatcactgttttgtagttccttaaaagagaccactgctctgaatctgactaaactgaagacagagcaccaaaatcaaatggggattcagatgtccaaaggatgggaggtgaatgataaaaatggttagagtcacaaattggaatccagtggagcgatagtgccgcagagtcaagatcctagagagcagaattctgagaaacccatgtccagagaatgtggtcaggaccttggagagctcatggtgatgtccaagtgtcttccacagtttagatctcagactagtgcaaaagtctgcatggggctccagccttgtaagggtctcatcttgttttatttggaggctctgacatagtggaactctgggtgccaaagggatagttcagaacaggaatcttctgacctggatagggcaatcaaattcttgattgtgttagtgcatcaggatccttgtcagataataagaacttttcatcttcctgtgtcagcagagttcagctctactaccagaatagaaaaaaaaattgcaaagtatatagcaaaaaattagcaaacagcaccaacttcttttcttatgtaacccacagtgaacaagaggcaattgtctcaatcggattcaggaacaacactgggttacatttggattctatgtatttttagatgtttaatttctatttgcctatttcatgaaagattggtaatcacacataaatctgcatgagtaagaagagacccatgaaaataaatagtcctacagatgtaagatttgagataaaacatatcttaagtgaatagattgtctttgttcttcatgaaccttcaaccttcatgccacataggtttggtgaagaacgtttttgatgtctgttacccacatggagggtttctgcctgtctattttgggtagaagatacttagaacaaaagtcgtcttgaagggaggagaatatcaagaaataaatcatgtctgtgttcctataaaactaataacaaacttggtaaacatgcatctgaaaaataactagaagtgctattctactgttactataaaggaccctgagtactgtagatttggttaaactgtgggtagccaagagggacgaggacctggattttgtcctgagcttttggcaggctggtagagggacaagtcccctttggataagtccccttttctctctgggtgtgtctcctcatctgtagtagaaggaccattggattagctggtctacaagattcctttcatgatcagaagtacagagtaagtatatgaatgatgcgtgaattaatgaacaaacttctccctgttgcgacattccaggaatagcccatggacttgcaaagagaggcaaaaaatggcatctaccagctgcttcctcttcttaggagtctccaacagagcctaataacatggggaagcattactaaattatgactttgtgcaagattattaactcggagtgaatggctattctttttggagattttaagcagtcatggaaccaggatggactcctgagatggacaactgcatttattcacttcaaacacaacatgataaaaatgtttttgaagctgtaattttacatcctgaaaaaaggttaaatttaaggcaatgtacaaagacaaagaatgactttgagcaaatgcattaatttggtttgagatgttcagaatttaatgttgactaaattggttaatctgaagtcttttgggagtggtgacagttatcctgtccttactgtaatcaatgtgcttgatttggtggaaattttacatatagccttacgaatccttttgactgaagtgcaagtttcctctagaaacgaccagttttaggagggcgtgtgtgtatgtgtgtgtttgtgtaagaacacatactggacaagacttcttgaaaaacagactcagtagtgtcaagcagcatataactctccccaaaccaaagcctcctgccctattttctgcctttcctctgctccctggcagagctgacctaccatctctctcggtaacttggcaccactactatccagaaactgaagtgggatgggtcgttttgtttattccgtgaagttactgtgagtgcacatcctggaatctgagagatccagatctgaatctcagtctcttgtgtcttcacagcctgcctgtatgactgggataaacaaccttaaccattagtttcttcatctgcaaaatggggatgtagtaccttcctcacagagcaattatgagactaaatgaggtcaaatacgtgaaatgattagcaccttgcctggtgttttgcaagtaagtgttcaacatctgagaggcactactagtatcagtagtactgttggtatttatcaggtgccttctgtgtaccaggtaccaggtgaatccccagagatgaaaattggaccgagtctgtattttcaagtagctcaaaatctagcaagaaaaaatggcaggcaagcaagtaatcagggaacaattgggtaagtgaggtgacaataaggcattaacataaacccagacaaggggcagtaaggaggggaggggctgcttcttgaaaaaggtgacatatgggatgactctttttttttttttttttgtttttgttttgagatggagtctcactctgtcacccaggctggagtgcaatggcacaatctcagctcactgcaacctctgcctcccgggttcaagtgattctcctgcctcagtctgctgagtagctggtattacaggcatctgccaccacacccagctaatttttctatttttagtagagatggggtttcaccatgttggccaggctggtctcaaactcctgacctcaggtgatccacctccctcggcctcccaaagtgctgagattataggcatgagccattgcacccagcagggatgaatcttaaaccaagtgacaaaaaggtaagaataatgactgatacattcagggatcagggatagtctgtgcagaggccagagagaagagtatggaggttggagaaaggcagccctcctctgccctggctccagagaccccatgtctgccacagcacaattgtctgagtcctgcagtaaatgctgtaaactgttgttgttggttttgttgttgttgttgttgttttgtttgtttgtttgttgttttcagttagaagcagtgtcattcatacaaatgaaataccaaacaggacccccatggcagaggcaacttctcattttatctcttgctcctcagcgcttttgagtctctccctgcatcacttccctgccctacacctgccaggtctgtgggtcctctttcatgtttgtagttctccaatactcttcaggcccagtgatccttttcagactcttgtcctctagaaaagcaattcagatctcgcccaaggcttacttctcggtttctggctataattgccctcatagtaccctgaccccagactcctactggatgccatccgaaagagttctcgaagccctcatctgcgctataggcacagaccactctccccagccctgacaaccctgacctcacatgcccttgggatttccgttcctcttccactgttctttttttttttttttcttagttgcagagtttttcggaaggactgattaccgagtctcttctttccccaagagtacttctttgtcacaaatgattccactccttgaggacatttggtgacatttaattcatctcctgttctctgcttggatgaattctgggaactccctgagaggaaggacaaggcagtggaacatctgagcaatgcgatctttatgtggtgggtgaaggtgatggattttcatctccttcttcacgttttttcctgctgcatggggacctctgggcattctcctttctcttccttgcttttaactgatttattcttttcaggcttatgacttttcttttgtgataactgatttattattttctgataagttattcttttgtgataactgatttattcttttctggcttctgacttttcttttgtgataactgatttattattttctgataacttattcttttgtgataactgatttattcttttctggcttatgacttttcttttgtgataccagtttgtaaatgtgtaacttgtctgatctttcttctttcagcacccacctctcatgctatagcgtttgcactccattgcatattgtttaagactgggactcatttgagttgtaacgcaggtgtgagaagctttgcaaggctacagaactgtgttcatccgtctcttgacttggactatggaagttgccacctgctcagatgccctgaatggtatgttgggctctaaattggcctgacagtaccacagtcctcttccaatttcttggggatgtccaggcattggataatggcagcccagttgcttctgcttgcagtggaaggaagggttggcatcgttccccagcacccaccatttgctgggaaggaaggactgttcttccctttctttaacttgcacctcaatgcataaagaatatctgccctttccccaacatggggcaggggtggcctgctggaatgggagttccagcttctttctcaatcccttattcactcctgtcataggaagacaagttgctaaatgactgtgggaaaccgaaacacccttccagccacatatactgttagataaggttcctggctctcaaaggcagagccccacctccattctccattctccctcttccactctctccatccaggtgcagcaagccgttttgtgcttcctgttccctggacccgcccaagccctgagcaggcatgggtttaccctccttgtaccatctaatgaggccgggcagagcatcagatgggaggttctggtcactctcaggcaaagccctgctctccagctcactttatgacagcactctgccttcagggttgtcatcacctgttcagataataatctagctcatcatttttcatctgcctggtgttctttgcgtgttgcttccagaggcagaatcccagagaagagagggaactgtcagctcctaagaatcactcctccagaaaagctcagcaaccaagaggaaaaaaaagaagaaacacagtgaaagaggaatgctttccttattcccaccctcatccctcacctattctttctctacttcctcacgttccctccatccctgggagatttaccatctgccattccctgtgtgtcatacagttctaggctctgtgcttctgtcctgcctgtgcctgaaattccttacaattttccccatttgccatccagccaacccctgcttattcaaaactcagattcagcctcccttcttccaggagatccttgactccccagccaggcttagctgccactcttctgggctttcccagtgcccagtcatggctctcatcagtgtattctctaaaaccattgacttcttcgccttccctagcaatctgtgagtctgtagaagaaaaggccatatcaatctaactttgtattcctggttcttggcacatagtgggtgaactcacacagactagagataaatcagagatgaatgagtgcccccttgagtccagggcgtacctgtaaaattgcaaatatctgcatgtacgagttgcaggcagggaaactgagtcacaagaagagttgcttgcataagacttcgctagtaaatggcagagctggtgcatgtgaaaatttctaaggcagaaatatgtacttatttaaaaattttttaaaaagcaagaaattgtctagacaagttttttctttgttcgtctgttgttttttgtttttgtttttgttttgagacagagtctcactctgttgcccaggctggagtgcagtggtgcgatctgggctcgctgcaagctctgcctcctgggttcacgctattctcctgtctcagcctcctgaatagctggcactacaggcgcccgccaccacgcccggctaattttttgtatttttagtagagatggggtttcactgtgttagccaggatggtctcaatctcctgacctcgtgatccacctgcctcggcctcccaaagtgctgggattacaggcatgagccaccacgcccggcctagacacaagttttaaccctgtaaattctgttgcctctaactgcaaccaaagccccaattcatcgcattctgcagagtgctgcccacattcacttggggaatcagcagcatgtacacctcattacttcacctccaaacccagctcacaagcaggcaggatgcgcaccaactgtccggttagcagagcttcccatttaaatcaaattctcttctcctcccaagctcatttcaaaggcattcattggtctgaatacatgtgctggtggaacgaaatgacactcaccccaaaacaaaaggaaaaaaaaaagctgatctgatgtaaaatctgtctgcatttcagagctgtcgagatgaaaaatgaagccacgagtttggcctttaaaaatattaatttcttataaagatgaactggagagtggtaactagaaaattcccttatctcctaggaagaaaacacaggatgaaattctggtccttcttcttgagtcttgtatgtcatttccaaattcaacgattacttgttcacggttcatttatgaggtttctgagcataatgaatgtccgcacatgtcactgagttattgatgaatcattgtttctattctgagctcagttcacgtagttcaatgtgctttggcttggctgtcactttaggagatgatagttaacccaacggagtaaatctggccagttcccgagtgggggcagggggttgggctcaactaagggcaccaacaataaatgcctccttgctggtagatgggaaggactgagaagacagaggggaaattgcttgcattctgctaacatctgcaacgtctgtaacagtgtcttttccagcagttgtaaaggatcctcactctccctttcctccctcagtcccagttcctcctccagagctcctcgtgatcatctcccaaagccactcacttgctgttctgtcctttgaggcctctgtccacttccagctcctgcctctctttcctggaccattgcagagtctcagaactgcctctctgctcccacttccatccattctctcactgcctccagaacattctccttttctgaaacactctcctctgcttgaaagtactgaaggcttcatcttgcctagtgcagcaattccacattccttataatctagtcccaaaccactgtctggcctcctctcctttccctccttctgaacaccctagattcctgccaaatataatgttattccacaaacctatgaggaccttgcctgccctctgtgctttgcacatgctcttcctccagcctttgcactctttccttccctcgtccacctgggagactcctgctgatcttttcagactcagcttaaatgtccccaccaaacctcccctccctctccccattggaaccagctccacactgcactccaccatgttggcatgtacagtacatgtggctaccagttgattgacagattgtccctgtaagccagtctgctcagggctatctctgacaaaatagtgtgttccccttccttggggagtaactttagacaatttgcagtggatactgggctgcagccttgatgctgttttttctctggaaactatgcttgaaatatatttgaatgaataaaataatacatctagtaaaaatacatttttctatttttttctaaaagtatcttacacattttccatcaggctcaattgtgaaatccctccagattcctaattatcttcttcccaagataacaagatttctgtcctctcttcacaaagacataggacatggactcagagacgtccaggcatctaactctctgcctgtctgtctctctggggaagccaatggtttttttgtttttgttttgttttgtttgagatggagtctcactctgtctcccaggctggagtgcagtggtacaatctccgctcactgcaacctctgcctcccgggttcaagtgattctcctgcctcagccttccgagtagctgggactacaggtgcacgccaccatgccaggctaatttttgtatttttaatagagacagggtttcaccatattggccaggttggtctcgaactcctgacctcgtgatcttcctgccttggcctcccaaagtgcttggattacaggagtgagccaccgtgcccagccaggagccagtggttttaaactgatcatcatccattccctttctcagacttaggtccctggtcctgtgtagcccctgttttcttacaaaacaggaagaagctctattgttggccagaaagcaaagcaaaggaacctgagcacacaggattctaactcatgctgttgatttcattagtataggtcttgcatcgtagatgccaaacagagtatccacttaccttggtggccacaaaaccaccttgaggactagcaaaagagccatatggggtcttttctgtctgttcaccccaccttctaaaatccccacctctcacacctggtctctgatgacacttgtctcggatgtgactctgtgtctgccccacaagatgatgtcttcatctgccatttaacccaaccctttctgagttctgatcatgttcctgcaccagggagtgagaatggcaaagccaaggaaaaacgtactgctgccctcaccgtactcatggtctagcgtggaacagcctcgctgctttactgggctgctgtgggaaggaactagcacagtgtatgcaatcactggaaaagacggctggggagctcaacagcaggagacaaagtccatcctagtattcccagagattctttctcatccttttatatatataaaaaaaaatttaaatttattatttatatatttatataaattattatatattttctatatattttataaaaattatatatttatatatatgaataaaatatattttatattttatatttataaatatatatatttataaatataaataaaaatttatatttttatatatataaatataaatatatttatatatttatatttataaatgaaactgtataatttttatataaattaatattatacattcatatatttataactcatccatatatatatatatatatatatataaaaaccttctggcgccacccaagggccagcacctccagctaaacattcaaaagcagaggagctgcattcctctccagcgtgagggaaccacactcaccaaagaaagccaaaacagaccccgttgacatgcacatatttccacaaacatcataaaagtccttttcactttatttcattaccagactatcagggagaatttcccagtggaaatcttcacccaatttgctccatatggattttctaccttattttactactgagaaagcagtctacatgttttatttgcaagagaatcaaaagatggaaaattgtcacatgagggacagtgagaacaggtagctgatagaaatacaattgacagttgcatcctggaagaagctctaacggtcttcatttctctcagcttgatgttgggccaagtttttacttctttaaaagaaaaaaaaactggcccttaaagcaataagatattgatcccttaaattatctgtgtattgaattaggctaacagaatctaagtttaagcaaatttgaaagaatgatcttgaacacgagataacaggccccgagtttgtactcccaggtaatggtgaccatacacttttaccataccagataatcaagaaatattgggtctgccactccttaatgtaacgctggcatgtgccttgagaatccagcacaggcagtttgctcctgaggaggaccaggggtaaagtttattctccctttttccttctcaactgtaattcacccctcaattactccctctcttgtattcccaaactgcattttcttttcgctcatatcctgtggtttgtctcaattctatgcagctaggtgcctgagctagaaactacctaccaaactggtgcctcattcccctggctcctcacatgaaacgtgcactccggccacagaacttagcagtcgctctgcatggggacagatcctggctctgtcatttcctctggactaactaggggaagtcatttaacattctgagcctcagttttgtcatctatgaagtgtgtcagatggtgaggaccatgtcacaggttgcggtgagagtcaaatagggataacttccagaaaactcacaaaggctgacatgtgttaagtgatcagtagatgttatttatttttacagtcatcatcaaaaccctaattgataactaggtattttttattccactttcctgtggtgtgtgtgtgtgtgtgtgtgtgtgtgtgtgtgtgagtttcactattgttgcccaggttggagtgcaatggcgtgatcttagctcattgcaatctctgcctcctgggttcaggcgattctcatgcctcagcctcccgagtagctgggaagagacagggtttcatcatgttggtcaggctggtctcgaactcctgacctcaggtgatctacccatctcggcctcacaaaatgttgggattacaggcacaagccacagacctggccttttgttccactttctaaaactctctttcattcctctgctactctccctcctggaccatctcgtctcacctggatggatatactgtcagtgtcaggttcgcctcttaagtcctcagtactgagcacagtgcctggcaacatatggccccaaaataaatccctgatccattgaattgaatattctagccctcgctcaccagttaattgatgttattcctggccacttccgggacatgggcagaggaaaagctattgaacatgtataatagccaaacatggcattcgtgatttagaagaattcggaacagacccaaaatatgctttggaaactcaaatcatccatcatttctcctataaatttcagtaatcatttctgtttggtttgttttaaggatttgatgcatttaaaatttaaatgtgggaaagttacgccttttgttttatttcctagtagtatgaccaatgaggcaaagaatccaaactcattaagtttcacacataaaggattgaaatgtgtacagtacttacagcgagcacaggctgagtgatgaagctctctttttaggccttgaacacgttgacatacgcaatatttttcatccacagaatatagtaagaacatcatctcacaccatgaaacattaatattggttttatgactgtgcacaatgcagtaacacattgctgagctgccaagaaatttaaagaataaaaaagatttagacactgaaagaaccttgaatcattgaatttggggaggtagggaggaaggttggagtatgcctaggagctgattatgtggcttccaacaagtgaactagagccaaactatgtgtattttaaatgatttggatccttaggtttagtactggtgggtgtggctcagttctgcctagtcaccattcagtggtgggtcaggaagccaatgggttcagcaaaaaaaccggaatgacagtctgtcagcatggaggtgaccactgaacctgtggaaggtaaggaaactactagaggaaggacagtgaccagcacttgtgacacatgctatctcttcccttttttgtacccatagtagacatcactaatcaatggcggcacctttgccctttgagtccagatataaccttgggatcctacttaacaaaggggcctatgcacagttgccataattgatacaatttgccatataaactgaaatgtaacattcctaaaatttttaaaaataaaaaacaaaggtagaaggaagcccaagttttgtcaatgaggctgcatttttaaaatgtaggtaactcttttcttatcacccagtagattctttaatggcaaaaaggccaggcttgcttaactactgtagttctctgtcaaatcactacactcatttatttggtaactattgaacacctgctttgtgacagcaacatacatgctaattggtagctgtcccattattttggcagttctcagttctgagccttgggacagggaagcctggaccatcttgctccagatttcagtaaattgggtccccgggatttaaagaggagatgaggatccccagatacgcttggaggtataaaggtatctccaagccacagttttcccgagacagtccttaagcgccgtgcccctcaattttcccagctgcgaaatgggcagctgctgaaaaagagaccctgcagcattgtcatgaggttcagatgagagagataagtgcctgggtcatagaagatgctctggaaatggcagcagatattgtcattatgctgatgttgctattgtcgtcattattttttgtctcagtgtacacccctgatgcatcggatgggagcaccttgctctccattcttagaaactgtgctcatgcacttgagcttgcctccaaagtctagagcctcaaggtcggcctgattattgacacgtttgactacctagctccaagcagggagagccctccaggccctcagtggtggtgttctcttgaagcctgtgcctcaaaaacactggtgaggaaaagcagctgtgactgcaggctgagaaccaaatacccaggtctggattaggtgtgtcacttacagttgctgctctgagatcagacccaggctcaaatcttggcctcaccacttaccaaccacacacctgtgagtcactgcagctcttgcgtgctcagtgtcctcatttgcatcacagggatggcattccgtgcctgcgattcactatgggtcttaacaaatctattccttctcttcccctcccacttcagtggtagcttcgcgaatcacgaccaagtcataccaggccctgttaagattcccatgtaacaacaactttctatgaaacaagaatttcacatacaacttctggggccaacagggctccagaatttactccctgcaatatccatgaactccagttttaaaactccaacccatgaaaagtaatttctaaagggaacaatgtgaaatacccaagagaaatgaaaacacacatccacagagaaaccatgaacatgaatattaatagcaacattacgataatagctaaaaagtgggaacaacccgaacgcccatccactaatgaattcataaacaaaatgggcctgtccatacaatagaatattatttggccataaaaatgaacgaagcactgtgagatgacgtatttttgttgctgaagccacctggcttgtggaactttgttccggcagccatggaaaatgaaggcagatggtgactgctgatggatatggaatttttctttggggtgatgaaaatgttctaaaatcaattatggtgatggtgatggttggacaactctgtaaatatgctaaaaacaattgaattgtacactttaaataggtggattgtgcactatgtgaattatatctcagaaagctgttacaaaaacaaaaacaaaaacaaaaagtgtcccacactatagccagaataatcttatcaagtcaaccgcctggttaaatcaccaccgcagggatccttttcctctcaggagaccaatctgagcctgtccatagatctgtaagacaagtaccatctgacccatctccatccagcccctgctcacaccacgtgtccctctgtctcggccctccagcccgggggtttccatcttcacccatgcccatcccagggcctttgcacatgctattcatgacctggagtattttttcaccttgctccatcctattgtcctcattacctcttaacctcccgtcagattttagctcaaccatcagtctcttgagaagcttcctggtctctgagagacggtcaagtccttcatggaggtgctttcattgcacccgaacctcttcagctatcatttcaccattagaatttagcataaacttatatgattaatatctgcctcccacactgggctatagtttgtgtaagagcaaggtccaggactatttcactcacctttgtacccccagaaactagcacatagtactctttattgtatttttttaattgatgtaaaattcacataacataaaattaaccacgttaaagtgaacaattcagtggcgtttagtacgttaattgatgtaaaattcacataacatgaaactaaccatgttaaagtgacaagttgagtggcatttagtactttcacgatgttgtgcatccaccacctccagctggtcttaaaatatctttatcatcccaaaaggaaactccagagccattaagtagcctctcccacttcttcctccctgaccccagtccctggctaaaaacaacctcctttctgtctctatggatttatccattctggaccttccatataaatgaactcattcaatctgtgacattttcgtgtctggagtttttcacttagcataatgttttcaaggttcttccatgttgtagcatgcatcagtatttcatccctttttatggctgaataatattttcttgtatgggtggagcacattttgtttatccattcgtctgtttatggacatttggcactgtttctaccttctggctaatgtgctgttctatgaacgtgtgcatacatgtatttctttgagtgcctgtttctaattctttggggtatatatctagaagtagtagctctatgtttaactttttgaggaaccatcatactagcaccatatgtggtattacacatagcagtgataccattttatattctaaccaacagtacacaagaattccagtttctccacatccctcccagcccttgctattttctgttgttgctgttttttatgctagccattctagtgtctatgaggtgccatctcatagttttgacttacatttatgtcatgattagtgatactgaacattttttcatgtgttcattggccatttgtatatcttctttggagaaatgttgattcaagtattttgcctacattttaactatgttgtagagttataaatgttgcctacatcttctggatagtagacccttatcagatgtatgatttgctgaatatttttattccattctgtaagttgtcttttcactttctttataatgtccacttcattgtatttttaaccaactaaataactaataagtccagtgacaggcatttagatgacatttgtgggcaaaacaatcaaggactcccatatgcaattactaatttatagctccctggatacctgggggtcaggaatcagtctgttgattggctgcgggctttcacttccatccaagcatcaggtcacatggtgccgtcatagctgcagactcacttgtgaataatggatgtcttcatataggaagggttaaacagcccctgtcctactgtgtccactgaccaagtccccttcatgatttatggatgatcacattgaaggaagaagagaggaataggagaagatgaggtttcccagcacgtccttttcaggacctccatgtcacgcctcactgccaattaacatttacttgaattcttggttccctccccagcagctgttgggtccagctctctggggatgtctgagatataaatgctcagacctgcacactgacatttaaagagccagtgaggggtctgcattctttatttaacaccttctttctgttgcaatatgaggtcctcccagatgcccctatgggaattactaatggccatcacatcttggttcagggaatggttgtctgcttttaagcaaagcctgagactcatgggtttgtactgcttcccagagggctgaggaggagaaaggggtaggaaggccacatccgtcaccctgtgatggatgcaccttgtgatacatccccctcgaaatcacgtagatgcatccaaaagcccttaaccattatattttgctctgataataaagcttagtcttttatgaccactaaataatacgtgtttactgtaaggaaaggacacaaaggataaaatgaacattgcataactacatcacccagagataattgctgttaatatcttgctgtatataattctcctgctctatttatatattgtaatacataaataccttttccacaaaaatgagagttcactattcatacagttgcataacctgcctttgcttctcaacaatataatagaaacattttccatgtcattaaatattcccctactaagcatttatttttaatgtgggtgcctctggcttaaacagcagcaatcttcagtgctgcaaagagctatgcttggtggatttgaatacattcttctgctcagagtattatgagtttgtttaaatggtacccgggtgaaaatatatcgctggctagccattcctggagcaggaagagtgtctagtcattcttgacttgctcaaatcctgtaaaattaaccatttctcacagccgcgggctacttttctggatgggaaaatttgctgggacttaaggttccagggcacagaccgggcggtcaatccctggcagatctgtagctctgttaaaggagacagggctggttaaaatttaaataaccctggaaggtcccaggctgaaatatgctacagggagacacaaataagagagacgcacaaatgtcatgagtgttcaaaagcagaagaggtcacattccacaggaagcaaaaggggaggagaagcctgagctgacccttcaagggcaggtccagtttggagaggtactaagggcagtaaatattcattcaggcattgactccactgatgtttaatgagcatctattaatactgcatgcccagcagtgcccttgctgtcaaggatatgacaatgaacatacatagatggtctccaacttcaaacaccttacagattggcacaattcagagcaatagttagcacaataggagagactactggatacagtaatattaataactgctcaataaatgtccactattcggtgtcctatgtgtatcatttcattagtgctcacaacaatgcggtgaggcagattctattattctccctatttgcaaactgaggcttagtgaggttaacgtacctaaagtcctatgtgcaggtagttagtagcggagtcaatctttgaacactttccgcctactgagtgtctgttcctgttatgaaaagcattttgcacatttcctcttatttaatccttctgacaaccttgcaaaggcaatgataaaattcccatgtttaaagacagtgttataaacacagagaaagttgtcatttgtccaggcccacagtaagaagtggagcagggctgtacctactgtggcctgaggaccactccatgcccactctacctcactgttaccacctcagtgaggcagagatcctggctggactaggggagagtgaatcaccccagggagagccatcctaaggctgacttcctacactgtcattgtgttagttctcatattcctataaagaaatacctgagactgggcaatatataaagaaaagaggtttaattggctcacagttccacaggctgtacgggaagcatggctagggaggcctcaggaaacttacaattatggcagaaggtgaaggggaagtaggtatgtcttacattgctggagaaggaggaagagagagaagggggaggcactacacacttttaaacaaccagatctcacaagaactcactatcatgagaccagcaagggggaaatccacccccttgatccagtcacctcccaccaggttcctcctcccacattggggattacaattcagcatgagatttgggcggtgacccaaatccaaaccgtatcaatcatttatttcattcacaagtgcgtattcagcacctgtcatccctggagctgtactgatgtgaatggagtcacagcccttgataggctcacaggacacaggaagccaaatgtgccattgtgataagtcagatattatgttaaatgtaggcatgggtataacacagtgtgggggcagaaaactggactcccagttagacagggacaaattagggcaggcttcacaggggagtaacatttgagctgacacttaaactatgagcatgtgcttacctgggagacacctggacggaggctgtcccaggcaaagggaatggcgttttcaaaggctcagaagtagagagagcatggcatgtttggctaactacggccaggaattaagtactgctgatagataatggatgaggggaggagtgggaggaaatgcaggcagagggggacagatctccaagggcctatggtgctgtccacagagtttaaatgttatcctggtagcaacagggagtcatgcaaggttgtagagaagtgtagcagagtgattggcattgagtgtcagcaagatcattttaataaatatgtgcgtgaggtgatgctatggaaccactggggctattttttgtggcctgacttacaggagaggtagtgagaatagaaagaagacaggtgtgagcaaattaaggaggtagaattgatcaacttagtaattgattaaattggtccaggaaggtccaaaatctaagactctaagatcaaggtaactcagcacccagttttcatttctgttcatttctctctctctctctctctctctctctctctctctctctctctctctctctctctctctaagtcaggtcagggtctccatctgccacccaggctatagtgcagtggtatgatctgagtttactgcagcctcaaactcctgagctcaagcaatcctcccaccttagccttccaagtagctgagactacaggcatgcgctaccatgccctggcttatttttatatttctttgtagagacagggttttgctgtgttgcctaggttggtcttgaactcctgagctcaggtgattctgcccgcctcccaaagtgctggtattacaggcctgcaccaccacacccagcctgttcatttctagtaagtccattattttacttcttttatttgttcttattaaagtttccatgctgttggagttaattgtaagtagaaagttgagaacggccaaatgtttggttggttgctgagcagaagagcaatacttagcatctttgttacataacagatctctatttgtgggagttaatatttataaaagaaagaaagatgcattacccatagatggtgccatttattctgtttatttttaaaatgcttttatgttgttaaaatcctagcctttggttttgcatctataatgaaagttgggcagattgtatttcagctggcatggaaggagaagatcttttctcttttacaaaaatcattactgcatttgttcattgatccaacaaatgcacgtgggcatttggaaagcaggtatggtctctgcccttccgaagctgacagttgagtcatttatccctgagtacagcctcagtatttacccctgttttaaacagctactcttccttaaacattgatagaatgtcagaaattagtcatcaagaaccaagggtgactttcagtggttatttaatatttcagacttaaatattcttcccacatgctcctgcctcaagacttttgcacttgctacctcctttttctgaaagtttctcctccaaaatatccacatctcctccttattcctttcatgactttattccagtgaagtcttctcaggccaccctatttaaaacagagccttggccaggcacagtggctcacacctgtaatcccagcactttgggaggccaaggcagtgggttgtttgagtccacgagtttgagaccagcctagtcaacgtggtgaaatcccgtctctacaacaaaatgcaaaaattatccaggcgtaggggtatgcccttgtagtcccagctgctagggagactgaggtgggaggatcacttgagcccaggagttcaaggctgcaatgagccaaaatcatgctattgcactccagcctgggtaacagagcaagaccctgtctcaataaataaataaataaataataaaagaaaactgagtctccaccctagaactttctccctttttatttcatctcctccttagcacataccactgttgatcttctttacaatcattctgctcatccagaatgcaggctctaggatgagggcatctttgtgaccttgtctatggctctgtccacactggctaaaagattgcctggtcctgggtgggtgaatgtttgtggaattaatggatgacccctctctgagccttgagtttctctcctgaacacagggttgtcaggggggtggttagtagggtgtaagggaaaaagagtagcagggtcccaggatccttggctctgtgagggctgctcccagcattttaggctgatcagactacttctgcagggcaatgctgggctggagttggtcttgctttacgcagatgtttctgggttacacaacacttggcttaatccttttttttttccatcaggcccataagacaatttaaaggaatgaaaaaatatgtatgttttaagggtctagacctaatgctagcagcatccctttggagaggttttttttgtttgttttgaggggtcttttgtttgttgagacactgtgcctttcaaaatttaaggtactgccttgttatgcaaatcacacatgtttctagtagaaaaaaaagtaaaagatgtagagaaagcaaagcaggcttcccatggagggataaatggatccttcccagcccacccactgttctgaggctgctgcccataagggttgttaggacacacaggagcctgagtggccaggtctctcaggagtggagacattcacttcccagccgtgggacatttacccaaaccactgcaaagagccacaaatagcataagaccgtgtgctgacggccagtggaaatggagctcagcgttgacagagcttcctgaagactgagctctcttgaaaatgtaaaattgctgaggaccttaagcagagtccgatcaaccgtgttggcccagttggactttcagcctgaactctaagaagcatggtccatccactgagcagaatggccattggtggagtttgcacttaaccatgtttgttaacttcctagggatcctgaaacaaatcaccaccaactagagggcaaacaacaactgaaatttattcagtttattgacaatcctagagccctgaagtccaaaatcaaagtgttggtaggccttgctgtctctcgtggtcccagggaggatcccatctgcttctgccagcatctagaggccccagttccttagtttccagctgcaaagctccagtctctgcttccaccttcaggggcccttctccctgtgtcttctcatcttctgtctcctataaggatacttgtagatttagggcacacccagctaatccaaaatcatctcgtctccagatctttaacttaattacatctgcagagacccatttttccaaataagatcacattcgcaggtactgggggttaggagttggatgtatattttgggcgaccaccattcaacacatacaagcccgtggagatagcactcacttcactttgaggagctatcattcttagttcctttgattttaaagctcatatctctgtccaggatttattgcacatctattctgtagttttaactgtaatagcttccacttgctgattttgttctgtgcaccaggtcacatggtcaacgatgtatagggattatcccattttatcctcataatagtgatggagggaaggtaagattgctttattttgcagaaccaggatgtgtgggcatcaaagagtgtgatttggtggctcacgcctataatcccagcactttgggaggccaaggtgggcagatcacctgaggtcaggagtttgagaccagcctcgtcaacatggtgaaactccatctctactaaaaatactaaaaagaaaaaaaaaagccgggcatggtggcatgagcctctagacctagctactccagaagctgaggcagaagaatcacttgagcccacgagggagaggttgcagtgagctgagatcgcaccacagcactccagcctggatgacagagcaagactctgtctcaaagaaataaataaataaacaaaaatttaaaaaagcagagctgagatttgtatccttattttggcttaaagtccttgctgttttcactatgccataagtgagcaaaagcagagagttaaagcatggtttctggctgggcgcggtggctcacgcctgtaatcccagcactttgggaggccaagatgggcggatcacgaggtcaggagatcaagaccatcttggctaacatggtgaaaccccatctctactaaaaatacaaaaaaaattagccgggcatagtgacaggtgcctgtagtcccaaactaaggaggctgaggcaggagaatggcgtgaacccaggaggcggagcttgcagtgagctgagatcgtgccactgcactccagcccgggcaatagagcaagactgcatctcaaaaatttttaaaaaatgcatggtttttgcttccaagcacctcataagcagagaggaagggacagagaactatctatggtttattgggacacgatgtaatatatgctacaagggaactgtgtcaagagctctgcagtctttctaccctggaaattttagtaaaggcttcaaagagaaagtgacccctgaggcggtcatttgggaacagcaggacttggctgcgtctgaatgtagagaattgcattctgggcaaagggaacagcatctgtgaagaaaggcaaaagtgagtggaccacccacatgatccctcgatagtgtccaggagcttctgtaggatgtagtgttatgatgctgagacactgtattaggctattcttgcattactacaaagaaatacctgagactgggtaatttataaagaaaacaggtttaattggcccatggttctgcaggttgtacaggaagcatggtgccaggcatctgcattgcttctgatgaggcctcagaaagcttacaatcacggcagagggcaaagcgggagtgggcacgtcacatggcaaaaacagaagcaagagatagggggaggtgccaaatttaaacaaccaggtcttaggagaactcactcactactgtgggggtggcaccaatgaaagctctgccccaagatccaaacacctcccaccaggccccacctccaacactgggggttacaattcaacatgagatttggtggggacacatatccaaaccgtatcagatgctcccgagccatgacttagatttgaattgctgcagacacgtgtctctggtggcttcctgtgtgccataccctaagctggcgtgggtggccttcccttcctgaacagcgtgatgctggtaacctgggacctccttccaccttcctgcactctataactacttcccagatcactccgaatttatatttgccatctcaggatatggcaaagtaagacacaacagtaacccaaactaaggcaagggcagtggggatgaggaggttggagtcgtgtgagagtctgtttggagaaggaaatcagtgatactctgttcagtgggtgtgggagaggaggcttgacacgagggggccccagttttgatgcatctaccagaacagggaaggactgtgcttggctggggagctgctgagcttgctttgggccatgctgtgtttgcagtgctcgtgacacattcagctggaaatgttgaacaagcagttagaagtgtagatctgggaattaggagacagttggtaatggaagctgtcagagtccacaggggtgggtggaaccaaagctggaggaataagcaggatatccaagaagaaggctgaccattagagactcggtggagattgcttaaagagctgccaggagtggcaacctaccaaaaaaaaaacttatcattctcccagcccaacccatacagggctcgtggaaagagctgggaaatgggctcccacgtggaatctttggactagtaccaacaggggttttggctactggggaggtgaagaatagtactgtgtatgccccagggtgtagcagttgagagtataaggtacagacccaagaggttgggtttctatcccagtgccaccacataggagctatgtgtcccaggacaaaagaatcctcaactgcacaatgaacacagcaaccacagcaacttcacaggggtatgttgaagaccaactaaggtaacccacctaaagggttgaatactatttccaacatgtagtaagtgctctgtgcacgtagccatgattattataatgacagcgtgtctgagtggagcccggatgaactggcaagcgatgaccacctgtggactgcagcgggaaggtccgcagcctggggctagaaccacaagggagcgtgatgcacacaggtgtgcttgcacccacggctgaggtttttcttcccaccggcacagggcgctgaggcagggatttcctcccagagagagggcggttgagttcagttcccctccactttgaaaatggctctggaggaggggcggaggaaaggcagagactccgtttattgttatttttaaaaataaaatgaaaaggagccctccaagggcttgtttatgggttttattattggcgaagaagagcacacttgtctttatcaacatcctgtctgtctgggagtctgagccgagaagggcaagaccaaatgttaagtcgtaacatctgacttgttgttccttgctctgctaacgatccaggctgttaagaggcttagcccttgtcagcagagccaatacaatttcaagaacaaaatgactgctggagcccagatcagaaaagggctgcctcgtgggagcaggtcagggcagtctattaggcatcttgtgcaaataatgctgaagaaaggtggtcagagaagctgactgtaccaggcataaaatcacggggggagccttccagaataatctgtggccgggttatgctcactgctttttctccctggtccacgaattagcttttggacaacagctgtggtgtaactggaatccatcttgtgtgattttttttccctcagatgatttagaattagttcaatttattttcaaaaagtataacccaatgacagcagaaaggccatgtctcaaattgctttcctgtccatggctagagtgggtgggtgtcatttgctgatttattactctctccgtgggctcctttcgtttctaaagccacctggaattatggccagcaatagaactctaaaccaaagtcagctttgcacgaaaatgcatttgacttaagagaccacggaaaatgctgattaaaagtaaccctgcatggcaaaatttgattaggagatcacatctgaatgggaacaggttcgagggaacggaggatgaatcaggctcagcaaagccaactttgattgcgcttttctaaggggaggatgtggtgctgattaaacgtctgaaattagtgggcagggaccattaacatgcaaaggactgatattaggcaaaggttgtaaagctggaatggctgcaagtcgtagacatttaaaacctagttttagaaacatccaccgacccctcggtgagctcctgtgcttctgtcactgggagtcagtaattgaattttctggacgttttgaccagtatgtaactgtgtggagccgattacacagcagaacgcaatttttagcctgaccttaaaagcattaccttctgctgcgtgattagaaaacatacagagagtgccgcccttctaactgcacttgatttggggaagaagaaagaaaaagaatcaccttgctattttatgaaacctggtaagattcatttagattccacacagatcatttaataacagattttgtaaaatcttaacatacggagccaccataaaacgtattatcttttattacccatacagagaatgacattttagatggtaataaattgaaacccaaggaaagctatttgctttcggagagtgcttggcgaatgacaggaatagcagtttcccaattttacacggtggcaaatatggccccccagggtcattggagccagcccccagctggctttgttgagatttatctgagcaacattctcttatacctcttttttttttttttgaaagatcatttccgtccaaacctcaccacatgaggacccagttgtcataccataacatccctccttccatcccgtacacctggagatgtgtggctggcctagggctgagcctggggctgggaccagccagtggggcatctgcctcaaggtggaaaagagcccagcccatcagctccaaagcagccacagcctccctctgcatagacacctctccaaaggagaaggaccttccctgcacactcttggacagccaaagcctcatcaccctgccacgccccgcaaaaccaggctttctagagactgattcagcctgtctaacattgcccatgcctgcctttggacctgtaacatctgcagaccatgagagcaacctgaggccaaatttgctgtgtggtgatcaacataaccgtttcttgatttactcattcattgaacatttactgagagtgactgagagtgaactagtttgtgtgatttttcccccaggagatttagaataagttcaacttgttttcaaagactataacccgatgaccacatacaggcagtgtcttgggacctcagtgtctcaaggggcaaggcactggggctatggcaggaataagttaaagacagaatccttgccctcaccaagggctgtaataaatacttagaaagtgactgacacattggaaaccacaggcaccaaagggaagcttctccggtacttgatatttaccactttgtagatggcaggacattcatcttcccactagacagattttgaaggaaaaggtctggttgacatcacacttcaaaggattgaaatggaaatattttccagagaaatgacagaggatgtcatcctgggaaggcaggccccctgggaagctggcaggtgggcgaggaatgaggtgcggctggtgaggccacgcaccacgtggagccaggaggctgctgggcgtctcagtgttccaggaaactcagcggtcaccccccagagaaggtgtactcgtttcctgtggcttccataacaaatgaccacaaaatccgtggcagacagcagcacaatatattatcctacagagctagaagtcagaagtccaaaataagtctcactgggccaaaaccgaggtgtcagcaggtctggattatttgtgagggctccaagggagaatccattttcttgctttttctatcttctaaaggcccctggaattccttggctcatagcctcttcctccatcttaaggccaacagtgtaatgtctctcctcgtctccctgtctccccatccccctccctcttctctctctttccccttattctttctccctttcccccccccggacccctctccctcccttcttcccctctccccctccctctttctctctgtctccctccctcctccctcccttgccctctccctctcccccaacaccatcttctctgcttccatcacccatctactcccgctgacactgatgtttctgcctccctctcatgaggactctcgtgatcacattgggcccattcagttttccagggtggtctccccatttcaagatccttaacaaagcctcttgtgccacctaaggtaaaatattcacagattccaggaattagaacatggccatctttgatagatgtttttctgtgtgccatagaagatacgagagcttctagatccaaaagcctggtggcatttagagctcacttccactgtgctcgatacatgaacctgacattgagcatctcacagcataatcacaggacggacgtgtgaagggaaaattgctatacagtgtcattatctcaaccaagagagaaacactcaccgtgccatacagccagggctaatgcagggaaggcaggagtgactctgggaagacaaaccttcatgatggaggcaaccttcaagcaagtgattgtttgattatcacttgcttgaagtgattatcttccaaaggataagtgattgtttcctggggcttaggaggtgggggcgggaaatgtgcagggagggcagagggtacagcataagccaagctgcagagatgcggaggagtgaaaaagcctaagaaggtatgaattacaaatagctcagctttacagaatataacactgagtgaggagaacaaacagatgaggccatgaagagtttgtctttcatgcttgaaaaactcagacattatcctgtagccactgaagggttttaaggagagtccttggtcagatggtagctggacagttcgctctggctggctttggggtggagaggggcatagaagaaggcagggggaccaacctggaagctgttgcataagtcaaggaagaagagatggggacttgacatcatgtgcacacagaggtggtggagaaaagaggacagactcgagaggaaggggaggtaaaatcaggagcactggatgagcagttgtttgaggtaagagagagggaattgctacagagactcccaggggccggctggagatgatccctccgggaagaacggccaggttgtggggaagatgggttctgatattggcccatggaggataagggagagcatctagtggagacatccataacaagattgaaagcaggcgagatgctgtttggtgtcttagagagagtctgttttttctcgaaatggacgtaaaaaaaaagaaagtttcaaagagaacttttggaaaactatgattttcatttttcatttaaattgcatcataaatgggtgagttttaaagtaaaacatctaagggtacatcttgacctgcattgagtcatacattcattcagaacaatgctaaccgaagtgtgcccctaaatcgacgacatcagcgtctccaagaaacttgtgagaaattcagatgctttggccctgccctgaaccttctgaatcataaatgctgcaggtgggctgtcaatctgtgttttagtacacccaccaggggattcttttttttttttttttttttttttgagagggagtttcgctctcgttgcccaggctggagtgcagtggcgtgatcttagcacaccgcaatctccaccttctggtttcaagtgatcctcctgcctcagcctcccgagtagttgggattacaggcacctgccaccacacccagctaatttttgtatgtttagtagagatgggggttcaccaggttggccatgctggtcttgaactcctgacttcatgatccacctgcctcttcctcccaaagtgctgggattacaggcatgagccaccgcacccagctggacaagcactttcaagaagcagtgactctgactctatgtcttacgtacctgctatgtaccaggcataatgttgctatgtcagggcccaggtctagaaaacaaaagctaatgtggcaaatagtacttgagcatctcaattactttttattttacttcagtgttacaatctgtacttccttgtctgaatctaacagattagcctgttctgttctgctcctaaccagccatgtgctcctgggattcactctgtttcctctcactgtgagttccttgaaggtagggcaggacgagaaggcctcgaaggtacttttgagaacttgtgtctcttcacctcacaaaccttgactccaggcacgctggtggccctgttgcagcctgatgtctccactcttattcccaggcccttcttccttctctgaattctctcccctcacacccatccttcaaagctcagctgcagtcttacattaacctgaagccactgaaaagccaccgaagcactcccagttagtagacagctaacttagcacaggctgcctgctgccctggggagccacttatatatcttttatcttcacccaagccgtggcttccttgaaggtcgagagcgtactttttcttgtccctttggtgtcctgaacagaaccagaatcagccttcccttcttattcaatgactacttttaatagagtttagggattaaaggtctcccaccttcttccatataatttgactttcagtccaagacaccatctctaatcctatggtagggtatgcccttctgcaggaatcactgcttaatctcttccggcctccacctctccacctataatgtctaagtcaactgtcccctcctttgtaattccacagaactctgtgcttaccccatctcattgtgctgagctcatcagggtgttggtctctcccacgggacttgattcctgttacttcttcgcaccatcccgcacaatgcctagcacacagtaagtgctcaatcaatgtctgatgaattaaataagctccatatagctttcctgagcaccccacattctgacccccttcatgtaaaccttaattggtattaataccattctgataacacttatctcatctgaccttacgtacttgccttttgttcatctctctggaccagaaatgcaccaaaagcagagtctgtatcatttatcacatcctagcagttatttgagcctaatagacactaaataaatgtttcagtgaactcacactgaatgtcaagtatttgccaccttgagcctacaggagatgctttttccaggggttctaggaacgccattggcagtttatttactgtaactcatcagtggcagcagaagatgcacacattgcctggaaatgttttatttgattttggtgtccctcaaccgcaaatctatcatttaggctattccagccacatatgtctaagagacagtgtttatttcccctgctgcttctccaccctgccagctttgtcgcagccagtaaatctggagaaatgagcgctgccttctccttgcccaccagcccccagccacgaatgcaaaaataaataaataaaaaataaaaaacagcaggtgacagccaagaatgtgaatgttcacattcgtaccaagaggtaaggtgaaaagaggcctaaagacaaacacaagtcaaaccaggctcaccctgctgcctgggaagatggaagaacatcgctcgacctctgcagtgggaataaggcacattttatgaggatgtgtaagcggttcctgctggatttatggactacctattcccagtgttatgtggccagagtggttaaatcaaactccagacagacaacaactcgttctgcttcagatagtgttttcaccaatcttttgcaatatttatagactaggtgtcaggtgcagccagcccggggaagaatgtggtccctgtttaggcttcatattgcaaggacgcttgtgatgcccagctgatcgggacaaagctaaagaggaaacgaatgaatgaattccattacatctttgctatgtagctcatgttaatgtttctcattaacgataccttaaatgttagactagaaagggatttgctaacaaaaatgccttcttacagccttccttgactcctagagcagcatgtgtgtgctggagcccattctcactggctcacaatagccaactggtgtctctgtttccaactaagtgcttttggagtggaatcatctgggtagcttgaaatcagctatggtaggagtagttaaaccaccaaaattgacaacagtacaaatcaggagaatctgttcttaaacagctacaggtataccactctattcattattttttatatattatatataattgtatatttatgtaatagtgtataaacatacagtatataaaacatgttatttgtcctgtaataattgtaatcaatattatgcaataatatgtaatcatatttatgtaatagtgggctaattgtgttataatatgactaattgttacatagctatgatgtcccaggcagtgaattttatctcccaggcagagacataaagcctctaaacaagaaaaggcccctgatctcaagaagctcggattgtcatagccacgatagccactaaacaagtaatcagtaaacaagcacattatagactgtggtagtggtaggtgctggggaaaacggtactcattatctattgctgcatgaaaaattgtctcaaaacttagtgacttgagacaagaagcactgattatctcacagtttccctgctcaggaatctgggcatttcttagctatactctgtgcttaatgggcactcacagagctacaagcaatgtgttcagaatctgctgtcttgctggaagatttgtctaaggaaggctccacttccaagttcactcagtggctgttggcagcatggttggcaattgcttttggctcttcctgaaggccaccctcagtttcttgttacatcttcgaaagacttcccaaaaattctactaaataatagcagtagcatctctccagcatttacatatgccaagctctgtattcagcactttacctcttttaattctcacgtatcctataaggattattctcccccactttacagatgaggaaatggaggcagtgagaacataagcaacttggctgggatcactcagctactaagtcatggagccagggtgataataattgatcacatattgattgactccttcttaaatgtcaaccatcctattgtgcaccaaggtccctgccttcgtggagcctctgtgctgtgaataatgaccatcagcaaaggagcaggaattcacctggagcaagaactagaggtgaaacattcgatatggaaaaagtggggtaccatggaaagaaattcggtctagacaaactgtaaagagagatgtagagtgcagttcaagaccaggcgagagagagatggggtactgtgtgggttaatgggaaaacctttttccacatcacatctatttgttgattttccccccacagctaccactatgcttgttattagtgataaatgttctgttaaatgcatacctgtgtggaagtcattgtagctgtgcaaaacgtcgagggtctggtgatggattaagtgccagatttaatgacatggcttgattcttttttcaagatgagatgtttgcttttcaaatcagtgtgatcagtgaacctggcctgtgtctgtggagattcactcgaggctttttcttgcagacataccatcttgcttttgtttctagaatatatattagctggtagctagttgacacccaggaggagacagcaaatgcaatagaaatgcatgactgcagaactcaaaccaggagagcagcttgactctcttagatatgtcttacaaatcagatagcttcaaataaaatcagaggagccaatttaagttttccagttttgacacagtgcatttcttcctccaaataaaattctatctccttgagctgcagttccgcaaagtataagtcattccctgagaataaatgactttgctttggaaatgccactgatatgctcagacctttgagacataatttagttcagggaaacagtaatatatcatcattatcaataatgaaagtaaatcgcccaccttgtgtgctgactactggctaggtgttgcagccaaaggcatggtccttgcccttgaaaactttgtcatccacttagggagatagtaaatgggcattcaaaataaagcaaaatgggacacatagccttcatattaaacaaggtaagctaagcacagtcataagcagcccttaaacctaaaaaatggcttatgtcttgctcacatcacagtctaaagcaggtcaccaaaggggctttgagctatatagtcatttggagatccaggtttcttccttttgaggaaatagaaagtgtgagaggttacatgggaggtttaagaaccacaccaagtacataacttctgctcacgttccactgaccgcaatcagccacacaagtccatttgactgcaaggacgcctgagctgtacagtctagccctatgcccctggaacccaaggaaataggatccagtgaacatacaacattgttttcaccacaagttcctttgcttgcaagtaactgaaactcattcaggctggttttggtacctaaaaggagctcttgagtatacagtggaatgagttacagaatcaacgaaagcgttgaagtcaggggccatcaaagctccagtccttggcagccaagctgcttcttcccggcagagcagcaccttttgcaaaattcagctcaaaagctgtttggagttgcagttgattacattcgtctttcctctgagccttgaaccaaagaaacacagaatcaggtgaggcccagggagaatacaacttgatcttgagaatggggttgaccttgataatggggcccccttctcactgatgagttcactcacctagtgacagggcagctggacaagtgaaagtgaacctggacaagtgaagaggcaggttgccttcctcatgggcagagagaagcacaagggtggtgagtttcctcccaaaacattcaaggcaaaaatccctctattggtcctaggagttcggggtttaccctacattcctgttttcctgactctcagtcccacatttcctcttttcagaatccagttgtcccagcttgaattagggagttacctgtgaatttagtcaattcttggcaagagagacaaacatgacaagtggccactgggatctctttctctgcatcaaaatttcctcctggagaaagggcatctgtgggctggacacctaaagagcatctcttccagcagagtaacaaatgcagagtggccagcgagggatacagaattaaaaatacatgtgtatatttcaagtaagagtgactccgagagctaggaaattagggggtgactttctggaaaaggctctgaggatcgggaagtaggtcagaggcaagtggaaggtattctgatcatgtatgagcaagggagttcatgtggcattttctctaattttcaagtgcaaactgggtgttgtacattccaaaggaggttactttcattatcggttttggggattttgttactgttctccttgtgaaagcaataatgttcattacagaaaaatccccaaatcataacaggccaataaactttttatattagaattgcttttaaaagtgaaaacttgggcagggcacggtgtctcatgcctataatctcagcacttggggagcctgtggtgggaggatcacttgagcccaggagttcaagaccagcctgggcaatacagggagaccctgtctctacaaaaaatacaaaaattagccaggtgtggtggcacatgcctgtggtcttagctacttggggtgctaagttgggaggatctcttgagcctgggaggtcgaggctgcagtgagctgtgatcatgccactgcactccagcctgggtgacagagcaagaccctgactcacacacacacacacacaaaaagtagaaacttagaagcaacccaaatgttcatccagtagggattgactaaataaattatagtggatctgtacattggactattagacagctgttaaaatgaacagctctgtaaacactgagataaaagtgatatggtaaaacaaattgtgtcgctatgtaaacagtattactttgatgaaatgtgtgtgtatataaatgtgtatattaaatatgtgggtatttaaaatgtacctccgtgtgtgtccacttgtataggaaaaaggagataactatcaatatttacctctcacaggtggggttgggcaagggtggaggagagttctttgaaatgactgttttatttttatgttgcttacaataattggatattacttcagtactaaaaatatttttaaggtcagccttaagtttgccagaaaatttagacttttgaaacctcatcacaaactttgcagtttatctacataacagtctaattgattctctactaggttaatcagtctatttctcattataggtgcaaagttttatttacttcaggagatagaaattggttcattttctaaaattatttataaaatttgttgaactacgagagttatgccaatgtatccttcccttgtgctaccgtaagaatttgtacatacctctgctaagctttgatttattttattgcactcatatgtgaatatgactgtcctcaacgctaaactttgacctctttggagaaagagacttgttttttgatcactgtatctctagtatccaacacgacatttagacaagaagttcattaactgccaattaaatagatgcataaactagttaaagaaagaattagaccaggtgcagtggctcatgcctataatcacagcactttgggaggccaaggtgggcaaattgcttgagctaaggagttcaggaccagcctgggcaacatggagagaccctgtctctacaaaattacaaaaattagctgggtgtggtggcgtgtgattatagtcccagctactcaggaggctggagtgagaggattgtttgagccaggaaaatagaggctgcagtgaaccatgaccacatcactgcactccagcctgaacgacagagtgagaccctgtctcaaaataaataaatatttttaaatagataattacagtaactttccctggctacaaaaaattttctgtttaagggaaagtattaaaagagaaaacgatgtattcataaaatgataggaatactgttttgaagaacctattttgatgctattgtatggtgtgatagctcctatgctttcttgctaatcagagaattgatcatagtgttattgcaatagttgcaatattagtcaaaactgccttattcctacctacggaacatctgaatcaagtgtcttgaggaaagccaaaatgtattagctcatagaattcacaaaatctaaggaataaattctggcttcaaggatgacaactcatccttgaatgatgattaacaacaacaacaacaaactccatctctacctcttagtctgtgtttccttcattctcaggttgactttctttgtgtggttacaggtggccactactagctccagatggatgccctaaccacctccaagtttaacagaaagataacttcctttccctaagcgttctgaaagaactaaaggacaatgtcctggaattgaatttcactcccagggtggactcacttaggttatgtcctcatcgcatgatgataggaatggaaagccctgattggccaggcctgaaccatatgaccatccctagatcaggagtggggtcagccccacccacctgaactgtacctgtactgagggtgaggaaggggtgatgcccgagggaattataacataggtaccagaagaagagggagtgggtatcaggacagttaagcagcatactcctgctatagttagtgcttgaggcagtcctgtagcacatccccacagcaatctgtactggaagttgaagaatgaatgctatgagaactttatctccttcttatgccaccatcatagagtcaccctagtctcccaatttgcttcaccgcgcaatgtcaggagctgtcctttagagaccagccctgtctgagatcaaaagctaaacattctcgtaggactggtataaaagttagtaacatcctcttggataaaaacattgaaatatgaataaaaagcctgaaaacattcatactctttatcctagtaattccacatcttgggatctatcagtcaaaaacaaaccaaaaaaatttttaaaaagcagccaaaatgtatataagccttcatgaataaagatgttaattgcactgttatttaaaattgtcaacattttgaaaaccacaaataaccaaaaggcctaataatagaagacaagtaaattataaaatatacatatgattatattgtaggcaacccttaaaataacatctaggaattatattggtaaatattatatgtgaaaaataatatgatatttaccataatctcttcaatattgggggagaatccacataattttttgtcagtaattgtgtgctttcaaaaataagtaacaatgttttatgacaaaagtgaaagcgttatgcaagaaattagacctgtgctgtccagggtagtggttcacatgttcagagacactcgggaaagattttaaaggtagccaatttactggtttcatatggtccagctgcagaaattatagccaatagtacatgcagtccagctcgtcagtgatgacaagcagaaagccacttccattaggctcaagttttccagcttcagcctgagaatagatgggatttcaagcatctataccgagagatgccaacgaaaccagccaggagcaaaattaccagaattcttgaaccaggcagaaccagggcagatggcatctcaagcaccttcgcagaccagcgccggctgacccagccagaactggaactgggtacggtgtcaattccacttgtactcagcagtcagagaaccgtgtgaccttcgatcctggcggagctggaattgaaaccgaaacatgaggcgtagagccatcacaggagcacactaacttcccactcatcaccgtgaattgaagtggagggccttaacaaaccacccagcagaaccaggactccttaaaatagtagctcagaaaccactcagaagttaaaggaacagcaatgaatggtgtccctatgagcagacagccagttgcacttcaaaatacttaaaagtttttgagagagctagcgttgagctattgaaatttaccatgtaaacttaggacttcagaagaaaattggacatcctccattgcttttttgttccttgcttcctgtggtatttcttaattattggttggtataaccagctgtttttgaagctgtcatactggtaggactatttatgtgattgtaaacacctattatttttgttactaaaggtagttcaactcggactctctgtgtgatgattaagaaatctgtccaacgtgagttaagcaaataagggaaattattgccttcattagctgaaaagttcacaggcgggtctggcttcaggagtggcatgatgaagcggctccagtacaaccactaagaaccatttcttttctgagattccagtataattaattctcttaggatattgcctttgttcttggatgcagggtcttcttctgcattacccctcctgtggtcatgagatgactcctctagctccccctgccaaatgcttccaggtccacaccacagggaaacagaacttccttcacctaactgtcaaacacagggcctggacttaacattatatcactggaataagatgcactgactgacttcttctaattaggactcattccaaaagttcaatcggtaggagatagagaaaggcaatcctaacccaaaccacatgagcagagaagaagtaaaggataggtccccaaaggaaatgcggggtgctgccttaccagatgaatggtatgattgtggaccaattcaagcagaaacctactaccaaagataatttaaatataggggctgttatttaccaatgactgcactcttcttcatcttaggatcagggctatttggctagttgttttgagtatataaacatgatagccaaatctttgtcaaatattgagatgaaaaacacttatgtgaagagagagaatagtgcaatattgcttgtgttaagtttatcaaatcattattggattaaatgcgtcttccacatgtgacagcctgtgcgacaaaaaagacatgaaagaagtgtggtataagtgactctaaacttcagtggggtttcttccccatctgtaaaatgggaacaatgattgcaagttgagctgcttgttgaaaagattaacaaggatttctataaagtgaggtaatgcaatgcctgcctcatcagattttcagtaaatgtgagttcctaaagctgccatctttgtcctaagctcatcatcaaaggtaacctcattttcagatcagcttcctgaggtctctgaaatagcagatatggatgtaaacattaaaggacaacgtaggggccgggcgtggtggctcacacctgtaatcccagcactttgggaggctgaggcaggcagatcacgaggtcaggagttcaagaccagcctgaccagcatggtgataccctgtccctactaaaagtacaaatattagccaggcatggtgatgggcgcctgtaatcccagctactcaggaggctgaggcaggagaatcgctggaacccgggaggcggaggttgcagtgagccgagattgcgccactgtactctagagagtgagactctgtctcaaaaaaaaaaaaaaagaacaacaacaaaaaaaaaaaaaaaaaaaaaaaaaaaaaaaaaaaacccaaaggacaatgtatacccaagcccaggaaatggaacattctgtgatatatcaaatgtctccctaaaaaagaacagtaaatatattgtccccatggcaaactccagtctttgaatagtgactgtcttatattgaagagattccaaaggcacatttatacacaataggtaaaaatgttatcactctttaaagatgcctaccctagatggaggagggggagagacagctccagcaacacgcctgccacctttccaaagcagtaacccaaatctaaatgtcatattatttctttgtgcttgtgctttgtagactctggaaaatcccaagtatgaactgatcatcgaggctcaagatatggctggactggatgttggattaacaggcacggccacagccacgatcatgatcgatgacaaaaatgatcactcaccaaaattcaccaagaaagaggtaaacccctgtgccaaacaccaaccaccactgtggtcacagctacaattactgattgatgttaattcacgtaccacagcacctgctggcccccctttcaaaatcaaaatactcctttgtgggagagacgatggtgttttgctggaattctttctcacatttttattttgtgtttgtgtgtgaggctaaaatactagagcacggtgagaacaagagcactgaatcttgttaaagtccataagaaaataacttttaatgcccaagtgccattttcatagttttattgctgttatttagcagtgagttatgagagtcccactgtgattttagcataacaataactatttttttccagcaagtgcagattgagaggccagacggaacagtagcaaggaggtaaagcagatttcctagtccataacaatgtggcccaggagcttataaataacaacaaagttagctcatccaggagagccattattcattctcagtccctgtgcttttatgattatggatcatggttgttgtttcccatttattccaagggagcgatgtttggggaagggctgagtacacaagatcacattcagttgctaaatttgtacccaaaccaggaagccatttgcactaagcacattctgatggaaatgtgctaagattgtggcttctttaggggcctgggccagggcatggatttgatgcccttcttactgaccaagtgaagaatatggaataggtacgatggcccctgacttttgcagagtctttactgtatctaccatggtgtctccccctgagatctgttgcctgatttgactgtgtgagcctggctttaccattttacaaatgagcttactgtgatgctcagagaatccagagaacaagctccaaggtcatggacagaaaaagtggcagaaacaggaagtgaaccaggttcctgtgattcaaaagctgcagtcctaactgtgatgctgtgctttcctcatctgccatcaatgcttccaacctccagggtgtttggagaaaaaaacctatatagggacctgcagttgccccactgctctctggaggaatctcaaggctacccagggtggcttgagacagatggatcctctcaacccccgagttccccaatggcctctgtattagttcattctcacactgctataaagaactacctaagactgggtaatttacaaagaaaagaggtttaattggctcatgattctgcaagctgtacagggatcctggctggggagacctcaggaaacattcagtcatggcagaaggcaaaagaggaagccagcacatcttcacatggaagagtaggagagagagagcaaaggggaaggtgccacacacttttaagcaaccagatctcatgagaattttatcatgagacagcactaggggggtgggtgctaaactattagaaagcactcccgtgatccagtcacctcccaccaggccccaactacaacactgggaattataattcaacatgagatttgggtggggatgcagaaccaagccacatcagcctcttcacctcggcatccccctgcatggctcactcaggaggtagacgtccccctttctccctgtggtgtcttgggcactcaggattccaacctcaaaacagcaaagtccacgggagcttgatttgctccattctctgacttcccatggcagggttcctctagctgctaatacagactgctcactcttgccatggttccaaactggcatttcaagaacaccagttctaattagttccaaacaattctaattcacttccaagaaattagtcacaaaaattacaccaccggggtggggataggaatgaaaaaaatatacttcagggtcaagtagatgtgggaaacactgaattgattacttttaaatggtttatttaactgcaggatttctgattaactttaaaatgctttgtgtttctctaacagggttaggtatggtctgtggggtttctcattcttctttggcctgggggcttttttttctaggctaccttatatggcttatggagctggtgtttcatggaatgttcactgggggatttttgtttatctttataatttcttttcaacctatttcaaaataaaaactcagagcacattgtaatattcaatataaacttaacgatgggaacaaaaataggataaccccaacccaaaatatgaagatgaatctgtgttaccagctgtgtgagattaattagttacttcaatgccactgtgaatttgggtcctgtgacttaggaaaaaaagaaatctttgctcagttgtggactaaacactgtgaatgacagactattgtttttaatgtcattgaatccaaggaataatttaacatggactctaaaggttagctaccattccacaatatcatattgatttcaaaatatcatattgtaaacactaaaagcatacaatgttatctgtcaatcttaaaaaataaattttgaaaaaagagacactgagtagcataaggaaaatgtatctgcctgtaaataccagcaaaagcacacacattttcttcaaatggagattagacaatgagtttgagattcccaaaaggcagagctgatacctaaactcataaagagagataagtaatcagatgaaaggaagtgataacaagtacactagactctcatttggatattaaatgtcccaaaggagtctttgcccaatgtttgataatttaaattcatgattaaactttctgtcgtgttcctgaaaggctgatgttctttgttgaaggggattcatacactttggatagtaacactgctgggggtaatgtgattgagaagtaaggagggggcgctggagccggaattgggttcacatcccactgaccagccatgtggtgggagcatgttaagtgctctacatcccagtctcttcacctgttaacgggctgatcgcagagcccacctcattaggtcattgtgaatgagctaatgactaaaagaacctagatagtgcctgtcgcccagtattttctaaagtatagagatgaggacagtggtgatgacaccgctgatgaggatggtgggaggaaggccatgatgaagaagaagattgtgatgagaaagatattattatgacagtgatgtttccaaaatgtcagaggccaaattgacattcttatcgaaagggccacctcccctccaggttaaaaggctactcttttcctttaaagtgacatatgaatctgctcaagcacttcaaaatacatggttaggaccctagagttctaggggagaagcaattctgcaggagaggtggcagaatctgtaaaatgcatcactatgagatcaggcctcgggacaaaagcgagagagaccaagagaaacctgctggggagaggagagctcctaatgaggactggctcagatgcagtggcctctaggatatggaagaggtaggaaaacaggatgccctagaaacagagaggaaagatggggcttatgatcttgaagttgaaacaaattttagagatgaaaatcaaggtttagtcattccaaaatagaaatggtgatcatttggagttgaggatgtccagaaagctctctaaggagatgttgtcctaagtaaattttttcatatcttaggacatttcgaagttgataagaatacatggtttttgggaatatatgaggtttttaaattctatcttacatgactttccctctccggagagatgtatccttttatctgtttttgaaatctatataaaagaggagttatgattgatcacaaataatagagactagaaataacactgttgaacaaaatagaggtagtttctctcacttaaaagtttggaagtgaaggctgggagtggtggctcgtgtctgtaatcccaacactttgggtggcggaagtgggaggattgcttgagcccaggagttcaagaccagtctgggaaacatggtgaaactctgtcgctacaaaaaaaaatacaaaaattatccaggcatgtagtcccagctacctgggaggctgcggtaggaggatcatttgagcctggaaggtcaagacagcagtgagtcatgatcacaccactgcactccagcctgggtgacagaatgagacccagtttcaaaaaaaaaaaaaaagtttgcaggtagacagacccaggccagtttggtaatgacatgatatcaatttcccaggttccccttagctttctgctccgccgccctcacggctgccttgtggtacaatagggtcactgcagcaccaggtataacagccagtaacaggaagtaagaagcagggaatgagaagaacaaaggagaaccggccacctgagtaaatgtcacttgaaaacttccccagaagactaagtgacttctgcttgcatctctgtagcctcccttacctgtaagggaggctgagaaataactacagttgtcttcagttggtatgttgcatttatagtgtttgtttaaggaaggagatactttaaaggttacttttaaaagtaaattcttattgcaaagtaagctcatccaggcacggtggctcacacctgtaatcccagcactccgggaggccgaggtgggtggatcccctgaggtcaggagttcgagaccaacctgaccaatatggtgaaaccctgtctctactaaaaatacagaaagattagctgggcatggtggcacatgcctgtaatcctagctacttgggaggcttaggcaggagaattgcttgaaccagggagtcagaggttgcagtgagctgagatcacaccagtgcactccagcctggtgacagagcaagactcggtctcaaaaaaaaaagaaaaacatgtaagctcaattctttagtcctctcgtgttcatttacaatgactatacacttgctgagaagcaacagccacatctctcctatcctctgttgtatcccggcaggcactcaataacagagcatttgctgaacgcttcctgaagataattttaacttcagaacagcttcactgcatacgatgaacgaagattgtacttaaaattgccgctgatacatgaaatcaattttcagtcattgatgttcatgcaaatttaggttggaaacgctagtttttctctgtggagagttttctataagttttcctaatagcttgtacgtatgacttcaactaactgttagttttgaacttcttacataaggtattttgaaatgatctgagaaaatctagttaaactcttcaaatacagactttgaaatatacatgaaaacttcagcagccccatttgtggctttttcattcttgtctcttaggttattttattaaaaaaaagatttctgatttgtagctagaacatggttgatgcccaacaaatactgattgaataagtcatattttcacataaatctcaggtcatggggattaataaactcgctattaattaaagaatgtgtttgcaagtgattataaaatttaaaaaaaacagaaaatttcaaatttcattttccagttctaccttaaaatggcaattggtcatttagatttaataatttaggactttttggcaattcaatgagttctttctaaggtaaatgttttggtgtttaagctataacattatcatacctataataaaaacgacataaaacttataagatcctgtcctccagctggaaaatgagagatgggcaaatgctccagttttcacaaagggacaaaggtaaatggtaggagttaggagctgtcaagctgcaagtgagccataggcagaaattcacatcaggttatcaaatgaatgctggagtccaggctccaatttctaaaagtcagtgtggagtcctgaagaatacatggtgcctcaagtatcttcttttcctgtggggtattagcattttttgttttttgagacaggttctcattctgtcacccaggctggagtgcagtagcacaatcatagtttcggctcactgcaacctcaagctcctgggctcagtcagtcctcctgcctcagcctcctgagtagctgggacttcaggcatacaccaccatgtctggctaatttttgtatttttttttttttttttttggtatttttgtagaggcgaggttctgccatgttcctcgggctggtcttgaactattgggcccaagcaatccacccacctaagcttcccaaagtgctgggattaaaggcatgagccactgtgcccagccagtattcgcatttttaattaaaatattgtgttaattaactgcctaatacaacctctaatagtttttctcttccatgtctggctgcaaactctatggtcacttcttcatataacaattacataagatcattgtctatagaaatataagaacaaaaggtataggctttcttctagcagggttgatagaaattttctctgtgtcatcaagagtttagaaactttttttttgtttttgctttcacaacacattttattattggaaaacttgtgcacattttgaggaatatcatcaaatttaaggacgtttctgtcatatatatgagctatgccaagcttgttcaacttgcggcctgtgagctggcagcatgcagctgaggatggctttgaatgcggcccaacacaaattcgtaaactttcttaagacattatgagattttttttttagctcatcagctatcatattagtgtattttatatgtggcccaagacaattcttcttccagtatggcccagggaagccaaaagattgggcaacccagaactatgcaatttccagtcttcttgtgtaaaaactaatctttaaatcaatgacacatattagctaagttgtcatccacatcctcgtatgaggcatattatgagttttatgttatctttattggagtgagcatggaagatcaaatcggcaagaatttaaatctttttccaatgtgtttattatgattcattcttcttcattagtggctttattaaacaatcaagaagctattttatttcttgtgttagaaatttaccttttcctcttaataaattatttgaggcagaatgatgtcaggatacctgtttatttcattttttaactttatcacttttgattataggccattcaagttttttactaacagctttattgagatataactcacatgccataaaattcacacttttaaaatgtacaattcattggttttcattatattcacagagttgtcgaattatcattactgtctaattttagaacattttcatcgtcccaaaaagaaacccgaacccatgagcagttactccccattgcccattcccccacgctggccaccactgatctactgtcagcctctatggattagtttattctggacatttcatatgaatggaatcatacaatacgtggtcctttgtgactggcttctttcacttagcattatgtcttcatggtctgcccatgttttagtgtgtcttagtacttcatttctttgtgtggctgaataatactccattccatggttataccacattttatgcattcatccactgagggacatttaggcagtttcagtttttggctattgtgagtaacgctgctgtgaacattcatgtaaaagtcattaagtctttatctgcgttttctctcacatcctaaacagctagaataaaaaaaaaaagtacccataatatcactccaaattagtaatctgtaattcctcagttgttttattgaaacatttcaaaatgcgtttctaaattgcagttaatatgacttattcaagacttatcaacttctttttgtcatgtaacttccatatgaaaaaagtacacaaatcctgagtgatttaattctcaacagatcaaacacaaaacccaaatcaagacacagaatatgatcagcaactcaaaagcttcctagggttcctgctagtcccaccacctgctcggtaaaacagctcctctcctgacgtctttcactataaactaatttttttcctatttttaccttatttatataaataatcatagtgtggacccttgggactaacttttgtgagacttatctatgttgttgcacatagccgtaatctattcatgttcgttaccatgcaaatatatttcagtttactccttcatcctactacatgtgggcatttgggttatttccagtttggggataatttaggtaatagtggaataagtattcttgaatgtgtcttttggtgcatatttgaagcttatatgtgtttctgtttggggtatatctacaggtgaaattgctaattcaacttcggttgattccaccagagtagttaactccagtttacagtggaacactcactgagaatcttgactgctatatattttccccaacatttggttttatcagttttttggtttgttattatttttagcctttccaatgtgtatgtagtgacatttccctgaggctttaatttgtatttctctggtggctgatgaagttgaccatcttccatccactggctgttgggattctacttttgggtaataccttttcaagtctttcaaccattttttaagttgggttattagtctttctcttatcgacgtgtttatctttattctggatgtgagtcctttgagttatatacatgttgcaattttttttttacactctggctttcctcttctctctctgaatgaaggtagagtcccaattttaatgaattccaatgttggttgatggttaatgtcatctgtgctctatttttgcctaccccaaaggtttaatttcattgatggatatgaaactatgtatatttcaatttgccaatttgtgtttttccaggaatttgtccatttcattttttttctctatttttcttggttggtcctgccatggagtcattctatccactttattaatcttttcaaagaaactactttttgttttgtggatttttctctattgggtgtttctttgtttttttccttctatctctttgggtatctttcaccatttatttttcaaacccctccctagaaatgatactttaatcattgattttcaatctttctttttttctaatgtatggatttaagactatataaattttcccttaagcatgactatagttgcattacataatatgtgctatgatgtattttcattatcattcagatcaaaaatatttttgaattttcttgggtcccttttgtgacttgtggttttctagaagtatattgctaaatgtgacatatttgggagtgttttttattcttttccattaatttctatcttaattctacagtggttagaaagcatccactatatgattacagtcctttgacatttgctgagacttgctttacaagctcacatgtaatcaattttgatagatggcccatgaatgctttaaaataatgttaattctgtagttgtttagtatcgtgatctatatacatcagttaggccaaggtttacaattttgttgttcaaaccttctatatatgttttattaatctgcttattgtatcagttactgaaagagtgatatgatatctataattacagatctatctatttctcctgttggtactattaaatttttaaaaacttaatttgaggctgtcttattagatgtatacaaatttaaaattgttatatcttcctaatgcattgactctttaccatcatgaaatgtacctctctatctctgcaaatgctttctgctttaacatttatctcatctcgtattagaataattatcttacctttcttttggtcagtgtcatcatggtatatttctttctgtcatttttttctttctgactttctgtaatcttatatttagtctgtgtctcttttaagtggtgtatgtatgggctttgattttttaaaatcaattccaataatgttattgttactggaattattttgcccatttacatttaatgcaagtacaacatattcgggtttcaatctaccagtctaagtatttgttttctatttgttgctcctttttgataaatttcttttcctcttatctcttatctttttcacatttacttgggtttttttataatttcatattcagctctaataacttattagttatacttcattttcatattcttgtagtgggttctgagaaattgcaatatatattctcaacttttggactctaacatcaagtagaatttttaggacttactggataatccaaggactttagaaaatttgagctccttttatcatcctcctaccttctgagatattgttgttatgttttaattctgtatcagtttatgtttttctacttatttaccctttgtattattatttatttatccctgtttttgtgcttccacatggaagaattttcccctctgattaaaaaattccttttattttaaaaatactgcaagtctgctggtaataagttctctcatatattatctaaaaaatgtcttttttgccagaatttttgaagaatattttcactggaggtaaaatcttggttgccagttattttcttagagaacttcaaagataacatttcattgtcttctgacatctatcatgtttgtcaaaaggtcagctgtcagtgttacttttatttccattgaaagaaacgtgtctcttttctctggctgctttcaaaaacattctttgtctttacttttcagcagcttaactgtgacatgctgaactgtggtttaattcgtattaattatacttgttccttaaatatctcaattcataaacccatctcttcaaatatttcttctgactcattttatcttcactgggaccctaattttatatatgaatgtgtttgtgtttgtatgcacacatacatatacaaacatacatatacacacacacataaatatatatatagactttctatgcttctgttgagctatttttaagctcaccaatcctctcttctgtctaatctactatacccatttattgatttaattacactcaggccaggcacggtggctcacgcctgtaataccagcactttgggagaccggtgggcagatcacttgaggtcaggagttcaacaccagcctggccaacatggtgaaaccctgtctctactaaataaatacaaaaattagtcaggcgtggtggcgcccacctgtagtctcagctgccttggaggctgaggcacgagaatcacttgaaccccagagttggaggttgcattgagctgagatcatgccaccgcactccagcctccatgacagaatgagagtctgcctcaaaaaaaattttttttaattaataaataataattacactcatattttaaattatgtaatttcaaattcttttttgaataaaattatcagctgaaattctacattttacctattttcatgaatattttagtcaaattatttacaattcaatgtctgctaactccagcatccattaatagatacttctgagtctatttctattatcagtccttttctcctggtttttggtcattggttatagtcgcctggcatacctaggaattttttaatttaattttggacaacatatatgaaaatgtttagagattagtagaggctctggctgatgattcccccagagaggattcccttttgctttctgtaaacagataagagtaggacaggatgactttaagtcagtctgagatggagttggtttgtggtgggactcaggctttttcaagggtgggtctacttcccagtgttcccttctcctcggatgcagctttcctggggtcctaactgaaagtctggtatgtttccagggctcctccactttggccgaccttgcatttcacttctcagtcccttgtctctgctgaaagctctccttggccctctggcctcttagacagcaccttctgctcagatgcttagcctgctcttcctctgccctcacaatctgggaaatgccttcaagggtaaaagttctatggaatattggcctcgcttcagtgaattttccttctctccaggatcctggactctcaagtattggctgccttaccagctcttcggcactttcaaataagtggggggttttatattaaatccatatcctggttgttctagatttgagggttggtcaggaagaagctttccccaatcatcataaagagagaaaaaatctggattagctttttaatctggagtatcaggaaaatatcagtagacatggtgcggatataattcctgtggcagaaagcataatattttcatttaaaatgtggagaaatataattaaatggcttcacagtacccactccatctcataccatttgcttcaaaatcaacttatttcagtaaaagtttaaaatgtttgaagtgtctcctacttgatgatatcgataagcaagaagggaactctaaatccaagaaagctaaacttttctttctgattcttcacttgatttgacatgaatatctacagttcccttaactctttgggatcttttcctctgtttttgatagtttggtgactccagctatgaagttagaagacacacctttgtgcttccaccctttgccagaagtctaattgaagtaaatatatttatccagtcctccaggattccgtgcaatatatttgagtgcttcaaagaaaagcctcctacttggataagcgtttacttcctttaggagaagagctctttaacatcagatgcacttgtgtctaaaccccgaccacgtaattacacattctgcttgctccaaagagattaatccagaaagccaaccacatatttcttagaagatggaacacatttcaattatctgactcaagtgacttttctggagggtggagtccaagacattttaagtaccagataaatctttgaagccgattaaatgtttttccaaatagtctagactccctcttcctatgaggctttttatagctattatagtgatatatgtgaggcttttttttcctgatactgtaaaatcacatatctgacagttttcagtgtggctgaggttttaaatcaacccaactatatgctactgggatctctatctcatattttgtacagaatggtggggaatatcaatatttaaagaaatggtatttttggagagaagagaacagtgtgatttcagtgcatgggtactagcagtttccaactctgtaaacagtgccatcactcatgattacatcatttcctgttctttcttgtcctggccaacactttgtccaaggactctaagagatcatctactgcaaattgcattcccaacttcccatcacataatcgaagagaggtttgctgcaaaaccgccaacaccttcatttcacatttatcttcacttgaaaggggtgagttcatcacttttttctcctgcaccaagaccataggaagacacgaaatcatcaactaaatcttccagcgttcaaatatcggaggccctggaaacagcaggtatgccgctgaatgtttttgaataaaagagagtgaagggaaacgtttgtacaaatataagcaacgatctacaaatagaagccatcatccaagcagtacagttccaactaaggaaaagggtggtatgtgcattcctggatttaattgttcatacacacaaggatgagctgtcttgcgttgttggaaatgcccacgctgattataaactctgtgtggaatgtcaaaacatctggatttttaagtgaaaaaatatataatctaccatgtggctgtttcttcaagtcactcctaaaggtagacaaggcagccagatgatttattgcattaatcactctttcataattatattcgtgatgtgttgatccccatcatccctgtgtgaacctctatgcgaattccgtgcctttgctaaacctctggttatgctcaagggtcagtggcaactcagtgacaataaaagcaatttttcactatagctggcagagtcttaccaccgagccactccatagcacagtggcctctgaagacttcatccacctccttctattcaaagataatatcctcatactaagagcaacaaccacaaagccataaaacatctacttttttaactctaagaatatgacatgactacacctccataatgcagtgtgcagaatgagaacacaggagttcagaaatagaaagccaagagcagcataaatggagcctgttggaagatgaaacgtccaggtccacactgcacctggaagccattttgtactgaacaattttagaagtaagatcatgggtctgatgcatacatggtttcaaacactgtccacctggctacagcctgccttcgtcttaggccacacgggagctctgtttacccctacgtgccaagctttggcatgtctttgtgccactacacactctgttcccttcttcccggaatgccttttccttcctttgtgcctgaaaaattccaatttatccttcaccacccaacttataaatcccccaggcactttgttacttcctcttccttgtcccaaaacatgttagcccccttcctagcctagagttaccacattgcctttcgcttgtggactcacaacccctctccctaatccgcttggaatgctttgctctttaagcccatctccttttcatctccgcctctagggccaagcacaggggcaacatcaagtgtttaattagagatgagtttattattcatgcagcaaatacttattacagaactgtgttttggcttctgatgtactattaactatcctttcattcactattatatacaatgttacctgtataccattatatgctgcgtataagtaatactctattatgtatgctattctattctaatatgcacataccctaatatgcacatattctagtctaatatataaatctattgtaatatgcacatatcctaataagcacattttctattctaatatataatatctattgtaataagcacatatcctaatatgcacatattctaatatataatatctattcttttctcatatgaacatatctcaatatgcacatattcaattctaatatatatctattctaatatgtacatatcttaatatgcacatattctaatatatatttctaatatgcacatatcctaatttgcacataatatctattgtaatatgcacaaatcttaatatcacatattctattctaatatataatatctattctaatatgcacatatcctaatatgcatatatctattctattctaatatgcacatatcttaatatgcatgtattctgttctaatatataatatttattctattctaatatgcacatgtcctaatacgtacatattctgttctaataatatatgacataaaatattaaatatgcaatattcaacttctggtgtgctatataattatttaattgcttattgccactctcactaaattagaatgtaagctcctcaaggaaagaaactatctgttttgtcatctgctgtggtcccgcacccagcctgccgtgtagtgcatgatcaaataactgatgaatgaatgaataaatggtcgatgcttgacaacaaagacaatcagaatctctgagtcatgttgttgcaaagcacttgcggccaggcatggtggctcatgcctgtaataccagcattttgggaggccgaggtgggctgatcgcctaagctcaggagttcaagaccagcctgggcaacatagtgaaaccttgtctctactaaaatacaaaaaattagccaggcatggtggcatgtgcctgtagtcccagctacttagggggctgaggcaggagaattgcttgaacccaggggttggaggttgcagtgagccaagattgtgccactgagctttagcctggagaacagagagagactccaaaaaaaaaaaaaaagaaaaagaaaagcactaggaaggcatctcattcaatacatagttttatagatgaggggtcctgctcaaggtagaaaacagatcccagaccaacctcactgtggcacaaaatgctgctgccgatgagaaacccaggctccagccctgcactaacatagcaagtcacaggatcatccccaagatttatcattgcactgtagtctgccaagagccgagacagttggagttaaattccatctcagaagtgaataaatgaatctacataaactgcagagatccctgaatctacttccctatcggtcaagtaaaaagaaaaaaaatcaagaaaactcaatgttaataaataatacataaaggaatcgttagagtggagacaggttcaacttatcctgtgagttaaaaaaaaaaatgaaagcaagaaaatattccacagttccagtgtgctgagctcattcttgtgagattaaacaaaataattcaggattaatatattcatttctttgcaaactactatctatttcagttacagactgagtatcagtttttccagtgttggcactttatttttgctgttgaccggctcagatctgaaagacaggattttatgagaagcgtcaccttcagcctgctttgcctgtgtgtgcctgcgtttgtgtatcacacgtgataacgttatgctgtcgctttccaaagtacattcattcattcattcatccacctgcttgcccatcagacatgtatgtgcgctatgcctcctcttttccaggctctgtgataagctagagcgcagggcagtgagtgaagtgaacagggtccctgacctcacgaagcatggctggggacaaccagccaaccagcacatcgatcctgaatgacccctcatgatgagatggaagagggtaaagtcataacagagggggactgcgagggcacttggcatggagctcagggagggcttctcagaggaggtgactgtattcatttcctgggctgccataacaaggtattaccagccatgtggcttcaacaacagatgtttattacctcacagctctggaggcagaagtccaagagcaaggcactggcagggttggttcctttggaggctgggagagagaattggtttgatgcctgtccccacacttctggtggccgccggcaacctttgtgctcctgggcttgtgcatgagcacgagcatccccccagttcctgcctccatctacacctggcttctccccgtgcccatgcctgtgtccacatttcctctttgcagaaggacaccagtcatatttgactagggcctaccatagtagcctcgctgtaacttgattctctctgtcaaggtcctctttccaaataaggttacagtctgaggtcctgagggttcagatttcagtgtatccttagggggagacacaattcaaagtctagcagtgacacagaagtggaggatgcagatggaagcgtccgtgggaagaccccggcctgggaagggcatgtctggcaggaggaactgaaagccacccagggtgaccagagcaacatgaaagagtcagggagggtgtgaggctggagagggcgggaggggccagatctcacccacaagacgaggaggctggatttattccaagtgcatggggaagacattggcagatgttaaaagagatagggaggggggccgggctcagtggctcacgcctgtaatcccagcactttcagaggccaaggtgggtggatcacgaggtcaagagatggagaccggcctggccaacatggtgaaaccccgtctctactgaaaatacaaaaattagccgggcgtggtggcatgtgcatgtagccccagctacttgggaggctgaggcaggagaattgtttgaacccaggaggcggaggttgcaatgagccgagatcgcaccactgcactacaacctgtcgacagagcgagactccgtctcaaaaaaaaaaaaaaaaaaaaagatatagggaggaacattccaagactcagagcccccatgctgcttaggaatactgttagtccacaagagtgagtcaatggctaggagattgctggggatgccaacagcatgagacccaacacctatgtccttcacccaagtgggaataacgccaaccacaggcagccaacatgagtagacgtttatgtagtaagtttcaagcttaggaagcccttccacacgccacatgctctctctcacctaatacttgcaccgtccagcaaagagggtcttgttgtccctccacgtagatgaggaaactgaggttaagtggcaccgattccttccctgaggtcactgggagctacatggtaagagtctggcctctgcatctgcttttcccttgcaaactcaaagagacgtctctccttcaagttgcaagtgtcctatcaagaacggcaattgtgtcgtgagtttctgtgaaaagcaagactggtcattccatcacttctgtctgtccaacatgccccagacttgctcttttggggccccatgctgttaagtaaacatcccccagccagtgtgaatatctgaaagcacctgctttgtacgcagcagggtcagagacctttatatgcacgccctcgagccctcctcctgccagcactgagacaggtaccatgatcgtaatacccctttcgtgggtatggagatgaaggctccgacagctgaagaacttacccaggctccagaccccaactctcaaccctctgctaagctgcttctgtcccgtgaaaggattagcaatttaccagtccagtgccagtagagcccactattcaggcatttctgccggattcagtggcagccattatatgactctccagtggtctagcccttggggtcagctctgtaggattccttgccagggctattcctcggggaatacctatcctgtttttcttgttacacttgtgcaccaagggtttgctgaagcagcccaggtctattaccaccgttttccactctgcttgaacttgcaaacttcaacttactgctggccctcttgctctcacctcacctgcctttttttttttttttttttttttttttttgagatggagtttcactctgtcacccaggctggagtgcagtggcatgatctcggctcaccgcaaactcctcctcttaggttcaagcgattctcctgcctcagcctcctgagtagctggaattacaggcatgtgccaccatacccggctaatttttgtatttttagtagagacgaggtttcaccatgttggccaggctggtctggagctcttaacctgaagtgatccacccgcctcggcctcccaaagtgccggtattacaggtgtgagccaccgcacgcagccacctcacctgcctttctgttcaaatcaggacaatgttttgtgcaaggcctggatataactacagcacacaaaagatttctctcctgggttcattaggataagttcaagttaccctctgtccctccgtcatttcttctcattataaaagggttggagggcttctttcaatagccagtgaagttgattagcaaccttgtatctttattttgataggtccaatgggaaaatatactaatcatttcttatgagcaaagaatagataaaaaaattcatccatataaataacttttcgaaagctaattattatcaagtgcttatctgtgtgaggcactgttcgagatgctttgggaactgtagctcatttaattctcacaacagccctatgacgtaggtactcttattgtgcccatttcacagatgaggaaactgaggcacagagaggtttaggacgatacctgagacttcagcgtggtggggcaggaatgtgaggtgtgagtcagagcacctggttccagaggcagctttcaaacacagcactgcactcccctgagcttctacacactcttccggccccatgggattccgaaatgagagaaatcaggcccccaaaagaccagccttcatcaggagactcggacgagaaagtcaaaaaacctatgttgaacacagcaccattcttgcagcagtattaacttttccacacttcagtatattcatgtgcgtatctactttaaaatcttcctgcatcaccatcaatagcttataattgatactccaataattagatatcataattgaaatccaggttttactcactggagaatttgggcaaagtcctgcaaagcaagagaaactttagttcattaatgaggctcatttttacattagcccgctctcgctacataacaatttttaaatctttttacatttatgatagtcgttactgcagtttcagaatcattagtgagataatgtgcttcttcaagttcaccagtctctgtgaatttgatatacttgttctgagttagcagggttgcagcggcctcagctttttggttcatgcagtcaccgcatgcctaccaaacacaggctgcgggctgaaggctggagattgaaataaggcagcaaattcttgctttcatgaggcttagcagggaggacaggtataaaaatagtacaagggtgaatcttacaaataaattcagagtgctttgggaacatgacctaagggaaatggacccgaagtctgggaaggtcagctcatgaagtgacatcttgtcctttaagacttggctctgctaggtagagtaagaaggggtggtacaaggttagcacaatccaggaagagcaaacattgtgtgcagatgccctgaggcatacaagagcccggttgaggggctgagaggtggggccagggctgggtgggagaggtggcacacacccagggactcagtcccctattacagactccaggaagccatgcatttccctcgagttcccccaaatcactccccagtcacgattaacgggctctcttttctttcacttgggccctttcagcgccttgtttctccctggatctcagcatccttcccagcatgcactatcggctttattgcaatcggtttctgcgtcttctgggcagcccctcttctggggctccttgagggcagacagagcttcactcatcatggtcgtccccttcggcctcggagcggtgtgcacagagggagcacaaagaatgtccgttgcattaaatcaaatctaacaaacagcactttttcccggcagctctacaaataggaacaggtgtctttgctaatcgcccctgaatgcacggttcaattcagggctgtaaatccatatatcagagccagaaccagttagctgtctggtctataataaccacgcactggcctctcacatcatgggcactggaccctgtggctgaaaagaaagtctcaacaaacccaaacaaactgaattgtccacttgtaccagcctcacacaggaatggtcaaaatacctcttttccttcagctctgggaaattgaaaagacaaatcagttagcggaagcctaagactagaggctcacccttcgacaaggaaattcacttgtattttctccggagtcaaggatcccctgtttgcactcatttcgttgttaggaacagaaatccactttcaaccagcagaaacgaatttcctggaaggcattggtactcatcactgggggaggttccggggctttccagcttcaggtgcagctgcgtctaagccctcagacaatgtggacgggatgctccttgtctgcagctccagctgtcagctctgcctgtctctctatgttggctttattctctgctaggctctctccttgtggcaagaaaggtgacttctgacagccctgatgccttatacacaaaggcaggaacacccacatcctctctcccagatccaaatgctactctcatagaaagacttttggtctctctgggtcacagtaccccctcagaccgggcattgattcccaggaaatgatgagataacgcccccacccctgccccaggtcagcagtccccagcctttttggcaccagggaccggtttcgtagaacacaattttttcacagatggcaggggtggtgggggatggtttcgggatgacactgttccaccttagatcatcaggcatcagttagattctcttaagaaacgtgcagcctggatccctctcattcccagttcacaataaggtttccgttcctatgagaatctaatgccaccactgatctgacaggaggcggtgctcaggcggtcatgctcactcacaggatgctcacctcctgctgtgctgcctggttcctaataggccatggatcagtacaggtccgcagccccaggggttggggacccttgccctagatcacctgcccacctctgggaaacaagatggggagaaaatgaggcctgtggttgactgcaccaacgtgacctcaaggagcaggttgtggtggttccctgaagaaagcaatgcccccagatcaaagctacatttcccatctactccagatcctattcaaacagaaccagttcccttgagcctggccatgatttgcatgtgaaaagctggtgtgttgcagccagtctgcaccagctttgggagagctgattgccgcatgtcttgccggttctgcatgtgtgcggtgatatcgagtacatagcttgaaattggccatggggggaatatttaagcacaaaaatggacacaagctacaaatcagggcttttccccctgaattgccattaaacatttaccagcacaatactgtgggttagttatggtgtttgcccacctaaagaaactctgtgtgtgtgtgtgctcatgtgtgtgtgtgtgctcatgtgtgtgtgtgcatgtgtgtgtgcacacgtgtgtctatgtgtgtgtgtgtgtaatttaagccaaaatgacggaccctgtgttatctttgcagatccgtggtctcaggccatgcttaattcttccacgctggtttattggttcctgtgttccaaagctccgcatgtaccctgtttaaaggacggtccacttccaccctatacagttggagggtcacccattcatttgatttcttcaggtccattttcttcatcctccttccacatgctactgaccatcgctaacaggactgcgtgctgagagccgagcctgttacctgctttccccatgacagggctgtctgcttcctctccctgtcccaagatttgttctttacctctcagaactgcagaaaacaagttattttctcttggcatttgtgccgctctttttcctccctcttttggcttcgaaaaagtggtgggtctcatgcacttgtaattagctggagcacatctgacccatcgtcccctgagggagggcagcttggtggtccctagctcaagaaggggcagcccccaccccctgaaattagggaggggaggtctacagctttttccaggaggtacctcagcccaaagtctgtgaatccacaaaagcaaggtcggcctacccttttacgtaagccacgcggtagccagagacaaatgcaagcaatagtgtgatgtgagatagggcagaaacactgcaccccaaagtcaggtgtattggggtctttccctgggagtccgatgcagcaagcaacactgtcacaggtaaaacgtgaggaaacaagcttgcttcttttttttttttttttcaaagcagggtctcactctgttgcccaggctggagtgcagtggaacaatcacagttcactgcagcctccacctccaaggctccaatggtcctcctatgtcagcctcctgcgtagctggggctacacaagtttgcttcttattcctgagctttttaaatttcttcagctgattttgccgtaccgcgtgtgccggtttcatcttcctcctcgttgtaattgtttcatgaccggagtcaatgctagaggccccgaggaatgcaggaaagcaccagccatcaggacgtgttgatgagacacacactgtctgggaccttctgtgaataacatgattggcgttgtcaccgggataactgcaggagagatgtgaaagtgcttaggatgtagttggcgctcaggtcattctgcaggcgttaatgaagcacgtgctatgagccagggtctttgctggggacctaaagatgagtaggtcagtggacaatatttgaatgcaagtcacaaatgtgtggtttccaaacctggactgggtggggctgacagggatttcttccattttttctgtttatctctgaatggttcctttagctgctgacttggcaactgaactcaacgttgtcctctgcccccaaggctctcttttgtccattctctctttctcggaggatgactttgcctcctacttccaattcaaaataaatcctgctggaagaagcaacggagccatgaccaaaagcagactttgggtcgagactgccgagtctctacttttactgaatttagtcctgaatcccacacagactccctgtacccgctctccctaggacgcctcggaatggtcctccgtgatgccgctgcgcctgtgctgtctggaccaccttctgccttggtgttctgacaacatcctagagcatctcacctctctcggctctttcccagttctcatgctccctgatggtccttaaaaagattcctattcagccaggcgttgtggctcatgcctgtaatcatagcattttgggaggccaaggccgatggattacctaagctcaggagttcaagaccagcctcggcaatatgaggaaaccccatctccactaaaatacaaaaaaaaaaaaatgagctgagtgtggcagcctgcacctgtagtctcagctactggaggggctgaggcaggagaattgcttgaacccaggaggcagaggttgcagtgagccgagattgtgcgcctgcactccagcctgggcaacagagtgagactccgtctccggggaagaaaaaaaaagattcctattcatggacctaataccccacttctaggagtggagtgggataaactagacagagatgaacatacatacagcgaagcagaattcctgagaggcctctgatctgaatagtgccaactccaggcattagctacaaaagaccttaattgcaaaactttctggggacttttatctttcctcatctggagtatccacaccattgtcctgcctgcgaggaatttggatagtttattttgtttttcattttgttttgttttttagacagggtctcactctgtcacccaggctggagtgcagtggtgcaatctcaactcactgcagtctcggcctctcaggctcaaccaatcctctcacctcagccccccaagtagctggggttataggtacacgccactgttaccggaaagaggtcccaatccagaccccaagagagggttcttggatcttacacaagaaagaattcgaggcaagtccgtaaagtgaaagcaagttttttgggaaaatcaatgaatacaagtatggctacaccatagacagagcagccccaagggccaaaggactatttcttgactgtgtgttaaacaaggagcagattattcaagacttttccaggaaatggatgggcaattcccagggctttttagaccgtatagggtaacttcctgacgttaccatggcatttgtaaactgtcatagcgctggtgggagtgtagcagtgaggacgactggaggtcactctcatcgccatcttggttttggtgtttttccggcttctttactgcaacctattttatcagcaaggtcttcatgacctgtatcctgtgccaacctcccatcttatcctgtttatgcctaaccgcctgggaacgcagcccagtaagtctcagccttatttcagtcagcccctgttcaagatggtgttgatctggttcaaacgcctctgacactaccatgccaggctaattttgcatattttttggagaagcagggtttccccttgttgcccaggctggtctcaaactcctgagctcaagtggtctgcccacctcagcctcctaaaatgctgggattacagatgtgagccccggggctctgcctggatagtttattttttatgtttgtcacatcgctcttctctgtctccactgataagtcacattccagacccttttatccatgtgatttcttgagatatcaagattcctacagacctgggaggaagtgtcgtacatctttgggcaaaagctgacctgagacaataggcaattgcccttgatgctaagactaaccacaagctcttcccagtctgtagtttttatttgcacatttgcaggctggagtgtgtcctctctatctagtcggtatttcaataggaggcgaagatctctgtgaggcaatctggggtttttctagctgggcccgtgttattcatggccagccagctctcctggtttgtttatacctttttcccacctgaaaccttgatggttgatttgtgaaataaaaccaaaattgctcaatctgtctaaaagctttctgtgggttttaaacttacctattttttaaaagaaattttaataatgcttctggcttttagaatcagcaggaaacctacaatcaggattgttgtatttgcaccaatatcaaacataaggagcataagtaataaggaacccagtgccctttgttgaatacgtaaattttcatggtaactggtaattgctggcctataaaagctctcttccttatgttcctgctactgagtaaaaatgatttttgtatttgtaacagactagattcatttcaaatggaaatattaatctgtaattgttcttatacgagaaacaccaagttcaaggcaaaaataacaaagccagttaagcatatgtttcatacctgcacaatttacctaaatagagattgcccaaagaagttttgctggcttctgaaaactttctcataagattttaaaaatatattttatggtcaagaggttgtagcatcctcccaggactaattcatatctagccaagaaaaattacattttcccatttacattccaaagtctgaactgttattttataaatgaattttccctccaattcagaaagcactggctacattacaaattttaatgctactattataggatcataattttaaaaacccagggttctccaagggcttcagcagcatgccatctctccactttattaaaatgaatgaacagatgtacaatttatttctgccaagccatcatctaaattcataagctatttctcatgtgtctgaaatccacgttggtttcccattttctttgccttagaaaaaaaattacactccctcatttatcactctggggacataaacgagaagtctactctccacttcattcactttggactaatatcctcgacacaatttaaatcccatctcttcaagactattcaatgagagcaaggcagtggaacacccagcatccaattggaaaactccttggccatcaatgtagaagattgacaagctcagtcacatgagcttacaccttggcagatgcaggggaagagagcttacaacagcgttgaatccattcaggtagatgggacagtctagaaccatcacacttaaaagtcaacgtcagtaacagaaatgtattttagctgccgtatttcatagagccctgataccacccttacttcccacatgacctgtcatctgacagcaggctggcagacaggcatttaacagattcatctcgggttggcaaacatctagcctagctttgaaaacccacgtgttgatctcagacctgcctttacatccctgcaccaccattttctgatggtgtgagatcaggcatagtttttaacctctctgagatctgggttatttttcagtatgatggagataagtggacctgctttgtaataaaggttaaataaagtgcaacattttgatgctatgaacctaaaagtatctgggacaggtctcagtcaatttagaacgtttattttgccaaggttaaggacatacccataacgcagcctcaggaggtcctgatgacacgtgcccgaggtgctcagggtataacctggttttatgcattttagggacacatgagatatcagtcaatgtgtgtaagatgtatattggttcagtctggagagtgggcgatcagggagcttacaggtcataagtaggtaacagacaaatggttgcattcttttgagtccttgatcaaagacggcggtagaggaatagtcacttatgtcttagtctagctcagtgaatctgcatttttacgtaaacaatcagactgaggaagcaattagatatgcatttgtctcaggtgagcagagggatgactttgagttctgtctgtcctttgacctgcacctgtgaagatgagcgatcagtttacgttgcccaggtgaaattcaacagaagtttttagagtaaagatcttgaggcccacaaggaatttccttgcaggcaaattgtgagggagatattttctatatttgtagctatcttattaaaaataaaatgggagcaggtttgcctcccataggtcccagctagacttttccctttagcttagtaattgggggtcccaagatttattttcctttcacaatgccaaggtcaataatatatggcaagcacagtgcctgacatgtggttcagtaagggggccattgtgatgaagatggcatcccggagatacatctctgccgcagaacagctgggctaaaagagctctcctcttcctcagttctgcatttgctggcatggttctagtgaatgtaagaaaggcattttgcagccagcagatgcagtcaacgagcgcaagttgtaaaggctgcagaatgaagccctcaggttatctggcagaattctgctcctggaagaattctatttatgagatgctgctggaattgagcaataaaacttgccggagtctctagtttcacatggaaaactgccctgtgtccataaatgcttcttgggtttggggctttaatcagattttgagtgtttggtttgttgttgtttgttctttcggtggccctgttgcttggagaagaaacatcatgttaacttcatttgcttgaactctgtgaccatcctgtgatttcaaacacagcttgtctttttctcatgtaatgtttttgggaggggaaggtgggttctcctgatctcgggaagatccacagcaaaatgatggagttctttcatttagcagagttacagcttgaggtggacagtgtcaaaatggcaagctccccaaagaggaaaggaaagagggatgtcactccaggatgcgccaacgagatgctccttaggaaccacggaagtgacacttgtcagcatccacacaacaaaatgttgatgaggggagccagccttggtgactcctagcagctcccggcagcagtctgtctgcctgtgttgtcaacagtccctgaattaaatcagtcactgctgccgccaatgaacttgtaggttgttgtgggataaggggccctaggcagtttcttcatctctgcttgaccaaaccacgcatcaaggtcatggatcccaggtgcccctgaagacattcaagaagtctcgttcgccagctgagcaaagtcatgagacaaactgtccatatgacaagcctgcttttaggctttgacattccagcaaggaagcaggtgctgctgacagaaatgtggtagtttgagagaacaggattttaaagaagaacgaacccaattatttggatccacagagtcttagaagatagaatgcagggaggaggcaagcagggaggaaagagaaggagcttttatgtttcctcattgttactccatcacactgtcagtttgactagaagggctgtttttatttccctgaatcccagttctgtttctgagttcttattcacagggcaggatgggctgacactgtagagacgtgtcctacagtgaaattagagatgactcctaatttcagtcacatctccatcagtcagcccctcttaggtattgcacaagttccttagatgctttgggcctcagtgtcctcacttacagaatagggattttggtaatgaaggccagcagctccgtgcatgacaaggtgctgaatgctttctgtttattatcacgccgaatccttatgatttctttgtgaggtgcattctactagaccctccagttctcagatcaggaagctgagggttagagagctaaggtaatgcacccaggttacagcaggttatcctcaagtgccccacggagtagtgacattttgtcaccattgatgctatattactgataatgatcaatagataggttactggaaaggggtccagatccagatcccaagagagtgttcttggatctcatgcaagaaagaattcagggcgagtccatagagtaaagtgaaagcaagtttattaagaaagtaaaggaataaaagaatggctgctctataggcagagcaacagcatgagctgctagttggccatttttatggttatctcttgattatatgctaaacaaaaggtggattattcttgggttttccgggaaaggggtgggcagttcccagaactgagagtttctcccccttttagaccatataggtaacttcctgatgttaccatggcatttgtaaactgtcatggcactggtgggagtgtcttttgacatgctaatgtattataattagcatataatgagcagtgaaaatgaccagaggtcactcttgttgccgtcttggttttggtaggttttggccagcttctttactgcaacctgttttatcagcaaggtcttcctgatctaaatcttgtgctgacctcctatctcatcctgtgattaagaatgcctcaacctcctgacaatgcaacccagtaggtctcagccttattttacccagctcctattcaagatggagttgctctggttcaaagcctctgacagatactgcatccatgaggtgaataaaggtggcaccggtgttcattttattggctaagaaccccgaaattgtcacattgcgtgcagtggttccggaggtttgacctcaccgtagaagagcacatctgaagttagttttgaacatattgacatcagtgttttgaaactcctcaccgctttctaacagtctttccagttagctgagtcagcacaaaaggccttagccaggtctgaaaggagtttgttttcatgttgcagggagtgttttctaataagggtttttttctccattgaaaacatctcttactttgcgtctatcattatgatcttactcggagagaaaatggtatcttcctgggctgattgctcattggtggaggcttggcttccaggaagacgcacactggctttccgtagcactttctctcgtttttgtttccaaaatcactatttattgcccttcaaaacaggttgcgtttgaattagggttctgggcctgtacagtctgtgggagcccaagtgcaaagtagattccatcataaacaaggtatcccccctccaaattaacagtaaaataggccatgtgatcccagaatgcatcatttcaggcttataaagaaaagcaacttagtttccttatttttccatttttccatgatcacaggctcacagaagttgcaaaaatagtgccagaagcaccttgaacccttctctcagcttcctccgtagtaacatcgcctataactgtagtgcaacaataccaagagcaggaagttcatgtgggcacaatactattaaccagacctcacgaagtctccacccatttttgtgtgttttctgtgtgtgtgtgtgtgtatgtgtgtgtgtgtgtgtgtgtgtgtggtcctacgcatttgatcacacgtacagatttgtgtgaccaccaccaccatcatgatacaggacagctgcatggtcacagaagggctacctgtcttgctactccttattagttgtattaaccttccccttactcttgggcttctcccctggcaattattaacctgttctccacctgtagttttgtcacttcaaggatggtacataatggaatcatacaatatgtaactctttgatattaactctttttttttttttttgagacggagtctttcccagccacccaggctggagtgcagtggcacaatctcggctcattgcgacctccgcctcccaggtttaagccattctcctgcctcagcctcctgaatagctgggactacagatgcctgccaccatgcccagctaatttttgtatttttagtagagacagggtttcaccatgttggccaggttggtcttgaactcctgacctcaggtgatccacctgcctcggcctcccaaagtgctgggattacaggtgtgagctaccacacctggctgagatgagctcttttcactaagcatgatgcccctgagattcatccaagtactcacatcagccgatagctggttccttttgattgctgagtgatattccatggtatggtatgccagagttcgttgaaccattcacccactgaaggacatttgactttgttgctagattgaagctactgcagttagagccaccctgaatatttgtgtaaggcttttgtgtgaacatacatttccatttttctgggtaccagctgctggatcatatattaagtgcatgttagttttataagaaactgcctgttttccagagtggctaaaccattttcatccttatcagcaatagaggagaaatccagttcttccacattctcaccagcatttggtgttatcactctttttcattataaccattctgttcagcatatagtaatagctgctctctggtttggtgtatagcaatatgatgttaatttgcatctccctaataactaatgatatgaaacatctttgcatgtgcttatttgccgtcagtgttctctttggtgaaatgtctaactatgtcttttgcctattttttgtttcgttttgttttacaggccattttcaggactttaacttttgcccattttctttctttttttttttttttttttttttttttttgagacagagtctcactctgttgcccaggctggagtccaggggtgtgacctcggctcaccacaacctccgcttcctggggtcaagtgattctcctgcctcagcctcccgagtagctaggattgcaggcacatgccaccatgcccagctaatttttgtatttttagtagagatgcggtttcaccatgctggccaggctggtctcgaactcctgacctcgtgatctgcctgcctcggcatcccaaagtgctgggattacaggtgtgagccaccacgcccggccccattttctaacagaatcttttaatgtttgagtgttgagagtcttttatgtagtctatatgcacatcctttgtcggagatgtggcttgcaaatatttatctcaatctgtggcttgtctgttcgttatcttaatagaatctttcacagaacaaaagtttttaatttcatgcaagtccaatttatacttttttcttctatagattgtgcttttggtgtcaactctaggaattctttgcctagccctaggtgttaaagattttatcctctgttttcttctacaaatttttatagttgtatttttacatctaagtccatgatcctttcggaactgatttttttatgtaaagtgtaaggtttaggttgagttcatttatctgccagtggacacacagttgctccagtagccttttagaaatagctatccttcttccattgaattgctattgtccccttgattaaaaaaaaaaaaaatcatgtgggtgcaggtgtatttgtgcaggtctattccgtgtcctccgttctgtcccattgatctatgtctctgtctcaccagtactgtactgtcttattaccggagctgtagagtaaggcttcacatcaagtagaatgagtcctctgctttattcttctttttcaaaagtatttcagaaaacattttttttcctttttcgacttttactttagattgcaggaatacatgtgcaggtttgttacgaaggtatattacatgatgctagggtttggagcatgatgaaccctagcacccaaattggtagtttttcaacctttgctccttccctccccacttttggagcccccagtatctattgttgccatgtttatgtccatttgcacccaatgtttaactctcacttcggactgagaacctgcagtgtttagttttctgcttctgttcattaagacaaaagcctccagctccattcatggtgctgcaaaggacatgatttcattattttctatggttacatagtattccacggtgttttctaacccaccattgatgggcacctgggtttgttgcatgtctttgctgttgtgtatagtgctgcaatggatatatgggtgcatgtgtcttttcagtagagtgacctattttcctttgagtatctactcagtgatgggattgctgggccaaatggtgcttcaactcttaggtctttgagaaatgtccagactgctctccgcaatggctgaactaatctacattcccaccagcagcatatatgtgttcccttttctcctagttctaccaacatctgtaattttttgacttttgaacaaaagccattccaactggtgtgagatggtaactcattatggttttgatttgcatttctctgctgattagtgatgatgagcattttttcatttgtgaattggccattcatatgtcttctcttgagacatgtctgttcatgtcctttgccctctttttaatggttatttgtagaaaaccattttaaatacagtttgaactcaacagctttttatcccctctaaaattattt
